United States Patent 7,745,391 (HUMAN THROMBOSPONDIN POLYPEPTIDE) - sequence listing, part 108

SEQ ID NO: 321805 - DNA, 7672 bp, Homo sapiens
ctggagttcaagatttctgatgaggaggcagatgatgcagatgctgctgggagggattccccctccaacacctcccagtcagaacagcaggaatctgttgatgcagaaggcccagtggtagaaaaaattatgagcagtcgttcagtaaaaaagcagaaggaatctggagaggaggtagaaattgaggaattctatgtgaaatacaaaaacttctcttatcttcattgtcagtgggcatctatagaagatctggaaaaagataagagaattcagcaaaaaattaaacgatttaaggcaaagcagggccagaacaagttcctttcagagattgaggatgagctttttaatccagattatgtggaggttgaccggataatggactttgcacgtagcacagatgaccggggagagcctgtgactcactatctggtgaagtggtgttcacttccttatgaagacagcacgtgggagcggaggcaggacatagatcaagcaaagatcgaggagtttgagaaactaatgtccagggagccggaaacagagcgtgtggagcgacctcctgctgatgattggaagaaatcggagagttccagggagtataaaaacaataacaaactcagggaataccagttggagggagtaaactggctacttttcaattggtacaacatgcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggaacacaaagtgctgctgacgggaaccccactccagaacactgtggaagaactcttcagcttgcttcatttcttggaaccaagtcgcttcccttcagaaaccacatttatgcaagaatttggtgatctaaaaacagaagagcaggtgcaaaaacttcaagctattctaaagccaatgatgttgagacgtctcaaagaggatgtagaaaagaacttggcccccaaagaagaaactattattgaagttgagctaacaaacattcagaagaaatattaccgagccatccttgagaagaatttcacatttctttccaaaggcggtggtcaagctaacgtacctaacctattaaacactatgatggaattgcggaagtgctgcaatcatccgtaccttatcaatggtgctgaagagaaaattttggaagagtttaaagaaacacacaatgcagagtctccagattttcagctccaggcaatgatccaggctgctggcaagctagtgctgattgacaagctgctgccaaaactgaaggctggtggccacagggtgcttatcttttcccagatggtgcgctgcttggacatactggaagactacctcattcaaagacggtacccatatgaaaggatcgacggccgagtaagaggcaacctccgccaggcagctatcgacagattctccaaacctgattctgataggtttgttttcctcctgtgtacaagggcaggaggtttaggcattaacctcactgctgctgatacctgcatcatctttgattcagactggaatccccaaaatgacctccaggctcaggctagatgtcatagaataggacagagcaaatctgtgaaaatctacaggctgattacaagaaattcctatgaaagggaaatgttcgacaaggctagtttgaaactgggcctggataaagctgtgctacagtctatgagtggaagagaaaatgctaccaatggggtacaacagctttccaagaaagaaatagaggatcttctacgaaaaggggcctatggtgcactcatggatgaggaggatgaagggtctaaattctgtgaagaagatattgatcagatcctcctacgtcgaacccacaccattaccattgagtcagaagggaaaggttccacatttgctaaggccagttttgttgcatctggaaataggacagatatttccttggatgatccaaatttctggcaaaagtgggctaagaaggctgaattggatattgatgccttaaatgggaggaacaacctggttattgatactccaagagtgagaaagcagaccaggctctacagtgcagtgaaggaagatgagctgatggagttctcagacttggaaagtgattctgaagaaaagccctgtgcaaagccacggcgtccccaggataagtcacagggctatgcaaggagtgaatgtttcagggtggagaagaatctgcttgtctatggttggggacggtggacagacattctttcccacggacgctataaacgccaactcactgagcaagatgtagaaaccatctgcagaaccatcctggtgtactgtcttaatcattacaaaggggatgagaatatcaaaagcttcatctgggatctgatcacacccacagcggatggccagactcgagccttggtcaaccattccggtttgtcagctcctgtgccaaggggaaggaagggaaagaaggtgaaagcccagagcacacagccggtggtgcaggatgccgactggctggccagctgcaacccagatgccctgttccaggaggacagctacaagaaacacctgaagcatcactgtaacaaggtcctgctgcgtgtccgcatgctgtactacctaagacaagaagtgataggagaccaggcggataagatcttagagggtgctgactcaagtgaagccgatgtgtggatccctgaacctttccatgctgaagttcctgcagattggtgggataaggaagcagacaaatccctcttaattggagtgttcaaacatggctatgagaagtacaactccatgcgagctgaccccgcgctgtgctttctggaacgagtcggtatgcctgatgccaaggccatagctgccgagcaaagaggaacagacatgctagcagatggtggtgacgggggagaatttgatagagaagatgaagacccagaatataaaccaaccagaacaccgttcaaagatgaaatagatgaatttgcaaattctccttcagaggataaggaagaatccatggaaatacatgccacaggcaagcacagtgagagtaatgctgagttaggccaactttactggcctaacacttcaaccctgactacacgtctgcgccggctcattactgcctatcagcgcagctataaaaggcaacagatgaggcaagaggccctaatgaagactgaccggcgcagacggcggcctcgagaggaagtgagagctctggaagcggaaagggaagctattatatctgagaagcggcaaaagtggacaagaagagaagaggctgatttttaccgtgtggtatccacctttggggttatttttgaccctgtgaaacagcaatttgactggaaccaatttagagcctttgccaggcttgacaaaaaatctgatgagagtttggagaaatacttcagttgttttgtggccatgtgtaggcgagtatgtcgaatgcccgtcaagccagatgatgaaccgcccgacctctcctccataattgagccgatcacagaggagcgagcctctcgaactctgtaccgcattgagctgctacggaagatccgcgagcaggttctccatcacccccagctgggagagaggcttaagctctgccagccaagcttggatctgccagagtggtgggagtgtggacggcatgaccgagacttgctggttggtgctgctaaacacggggtcagtcggacggattatcacatcctcaatgaccctgagttatccttcttggatgcacataaaaactttgctcaaaacagaggggcaggtaatacatcttccttgaacccactggcagttggatttgtccagactcctccagtcatctcatctgctcatattcaagatgagagggtactggaacaagccgaaggcaaagtggaggagcctgaaaacccagctgccaaggagaaatgtgagggcaaagaagaggaagaagaaaccgatggcagcgggaaggagagcaagcaggaatgtgaggcagaggccagctctgtgaaaaatgaactgaaaggtgttgaggtcggcgcagacactgggtccaaatctatttcagagaaaggttccgaagaggatgaagaggaaaagctggaggatgacgataagtcggaagagtcttcccagcccgaagcaggagctgtctctagagggaagaattttgatgaagaaagcaatgcttccatgagcactgctagagatgaaacccgagatggattctacatggaggacggagatccttcagtagctcagctccttcatgaaagaacatttgccttctcgttttggcctaaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatcactacgtctcctcagttgtcaaaggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtctcaacaccagtgtctgatgcctttaagactcaaatggaactgctccaagcaggcctttcgcgcacacccacaaggcatctccttaatggctccctagtggatggagagcctcccatgaagaggaggcggggaaggaggaaaaatgtggagggacttgatctgcttttcatgagccacaaacggacgtcattgagtgcagaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccaaagaatgcagatgtgctgttttcctcatttcagaaaccgaaacagaaacgacatagatgtcgaaaccctaataaattggatataaacactttgacaggagaagaaagggtgcctgttgtcaataaacgaaatgggaagaagatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgca

SEQ ID NO: 321806 - DNA, 4062 bp, Homo sapiens
cggcggcggcggcggcggcgcgggggttgagtcgtggtggtgcggacgcgctcgtgctcgggaactatcggattaaacttgaatcgagtgaaattacacaaaggagcgccgcggaggaggcggcccggggacccggacaccctgaaactcaccagagacccgttcgcccccggccaactccgtgcccgtggattcagccccctggccgcagctgccgagccaactccggagcccgctctgcgttttgttttcccctcggcactaggcagcggaggagcccgaccgacccggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttggatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgca

SEQ ID NO: 321807 - DNA, 4142 bp, Homo sapiens
cggcggcggcggcggcggcgcgggggttgagtcgtggtggtgcggacgcgctcgtgctcgggaactatcggattaaacttgaatcgagtgaaattacacaaaggagcgccgcggaggaggcggcccggggacccggacaccctgaaactcaccagagacccgttcgcccccggccaactccgtgcccgtggattcagccccctggccgcagctgccgagccaactccggagcccgctctgcgttttgttttcccctcggcactaggcagcggaggagcccgaccgacccggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttggatgggtggagctatggcgcctccaatgaaggatctacccaggtggctggaagaaaatcctgaatttgcagttgctccagactggactgatatagttaagcagtctgttcaccacagaggctcacattgagatcaagttgtcttcgacagcctttatagccactgtttgcctcccctgtactccagggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgca

SEQ ID NO: 321808 - DNA, 3848 bp, Homo sapiens
cggccgccaacgtttttattttttgttcctcccggcgcggcggcgccagcccgcgcggggaccgccaccgagcgaggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttggatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgca

SEQ ID NO: 321809 - DNA, 1451 bp, Homo sapiens
cggcggcggcggcggcggcgcgggggttgagtcgtggtggtgcggacgcgctcgtgctcgggaactatcggattaaacttgaatcgagtgaaattacacaaaggagcgccgcggaggaggcggcccggggacccggacaccctgaaactcaccagagacccgttcgcccccggccaactccgtgcccgtggattcagccccctggccgcagctgccgagccaactccggagcccgctctgcgttttgttttcccctcggcactaggcagcggaggagcccgaccgacccggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaa

SEQ ID NO: 321810 - DNA, 5799 bp, Homo sapiens
ctggagttcaagatttctgatgaggaggcagatgatgcagatgctgctgggagggattccccctccaacacctcccagtcagaacagcaggaatctgttgatgcagaaggcccagtggtagaaaaaattatgagcagtcgttcagtaaaaaagcagaaggaatctggagaggaggtagaaattgaggaattctatgtgaaatacaaaaacttctcttatcttcattgtcagtgggcatctatagaagatctggaaaaagataagagaattcagcaaaaaattaaacgatttaaggcaaagcagggccagaacaagttcctttcagagattgaggatgagctttttaatccagattatgtggaggttgaccggataatggactttgcacgtagcacagatgaccggggagagcctgtgactcactatctggtgaagtggtgttcacttccttatgaagacagcacgtgggagcggaggcaggacatagatcaagcaaagatcgaggagtttgagaaactaatgtccagggagccggaaacagagcgtgtggagcgacctcctgctgatgattggaagaaatcggagagttccagggagtataaaaacaataacaaactcagggaataccagttggagggagtaaactggctacttttcaattggtacaacatgcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggaacacaaagtgctgctgacgggaaccccactccagaacactgtggaagaactcttcagcttgcttcatttcttggaaccaagtcgcttcccttcagaaaccacatttatgcaagaatttggtgatctaaaaacagaagagcaggtgcaaaaacttcaagctattctaaagccaatgatgttgagacgtctcaaagaggatgtagaaaagaacttggcccccaaagaagaaactattattgaagttgagctaacaaacattcagaagaaatattaccgagccatccttgagaagaatttcacatttctttccaaaggcggtggtcaagctaacgtacctaacctattaaacactatgatggaattgcggaagtgctgcaatcatccgtaccttatcaatggtgctgaagagaaaattttggaagagtttaaagaaacacacaatgcagagtctccagattttcagctccaggcaatgatccaggctgctggcaagctagtgctgattgacaagctgctgccaaaactgaaggctggtggccacagggtgcttatcttttcccagatggtgcgctgcttggacatactggaagactacctcattcaaagacggtacccatatgaaaggatcgacggccgagtaagaggcaacctccgccaggcagctatcgacagattctccaaacctgattctgataggtttgttttcctcctgtgtacaagggcaggaggtttaggcattaacctcactgctgctgatacctgcatcatctttgattcagactggaatccccaaaatgacctccaggctcaggctagatgtcatagaataggacagagcaaatctgtgaaaatctacaggctgattacaagaaattcctatgaaagggaaatgttcgacaaggctagtttgaaactgggcctggataaagctgtgctacagtctatgagtggaagagaaaatgctaccaatggggtacaacagctttccaagaaagaaatagaggatcttctacgaaaaggggcctatggtgcactcatggatgaggaggatgaagggtctaaattctgtgaagaagatattgatcagatcctcctacgtcgaacccacaccattaccattgagtcagaagggaaaggttccacatttgctaaggccagttttgttgcatctggaaataggacagatatttccttggatgatccaaatttctggcaaaagtgggctaagaaggctgaattggatattgatgccttaaatgggaggaacaacctggttattgatactccaagagtgagaaagcagaccaggctctacagtgcagtgaaggaagatgagctgatggagttctcagacttggaaagtgattctgaagaaaagccctgtgcaaagccacggcgtccccaggataagtcacagggctatgcaaggagtgaatgtttcagggtggagaagaatctgcttgtctatggttggggacggtggacagacattctttcccacggacgctataaacgccaactcactgagcaagatgtagaaaccatctgcagaaccatcctggtgtactgtcttaatcattacaaaggggatgagaatatcaaaagcttcatctgggatctgatcacacccacagcggatggccagactcgagccttggtcaaccattccggtttgtcagctcctgtgccaaggggaaggaagggaaagaaggtgaaagcccagagcacacagccggtggtgcaggatgccgactggctggccagctgcaacccagatgccctgttccaggaggacagctacaagaaacacctgaagcatcactgtaacaaggtcctgctgcgtgtccgcatgctgtactacctaagacaagaagtgataggagaccaggcggataagatcttagagggtgctgactcaagtgaagccgatgtgtggatccctgaacctttccatgctgaagttcctgcagattggtgggataaggaagcagacaaatccctcttaattggagtgttcaaacatggctatgagaagtacaactccatgcgagctgaccccgcgctgtgctttctggaacgagtcggtatgcctgatgccaaggccatagctgccgagcaaagaggaacagacatgctagcagatggtggtgacgggggagaatttgatagagaagatgaagacccagaatataaaccaaccagaacaccgttcaaagatgaaatagatgaatttgcaaattctccttcagaggataaggaagaatccatggaaatacatgccacaggcaagcacagtgagagtaatgctgagttaggccaactttactggcctaacacttcaaccctgactacacgtctgcgccggctcattactgcctatcagcgcagctataaaaggcaacagatgaggcaagaggccctaatgaagactgaccggcgcagacggcggcctcgagaggaagtgagagctctggaagcggaaagggaagctattatatctgagaagcggcaaaagtggacaagaagagaagaggctgatttttaccgtgtggtatccacctttggggttatttttgaccctgtgaaacagcaatttgactggaaccaatttagagcctttgccaggcttgacaaaaaatctgatgagagtttggagaaatacttcagttgttttgtggccatgtgtaggcgagtatgtcgaatgcccgtcaagccagatgatgaaccgcccgacctctcctccataattgagccgatcacagaggagcgagcctctcgaactctgtaccgcattgagctgctacggaagatccgcgagcaggttctccatcacccccagctgggagagaggcttaagctctgccagccaagcttggatctgccagagtggtgggagtgtggacggcatgaccgagacttgctggttggtgctgctaaacacggggtcagtcggacggattatcacatcctcaatgaccctgagttatccttcttggatgcacataaaaactttgctcaaaacagaggggcaggtaatacatcttccttgaacccactggcagttggatttgtccagactcctccagtcatctcatctgctcatattcaagatgagagggtactggaacaagccgaaggcaaagtggaggagcctgaaaacccagctgccaaggagaaatgtgagggcaaagaagaggaagaagaaaccgatggcagcgggaaggagagcaagcaggaatgtgaggcagaggccagctctgtgaaaaatgaactgaaaggtgttgaggtcggcgcagacactgggtccaaatctatttcagagaaaggttccgaagaggatgaagaggaaaagctggaggatgacgataagtcggaagagtcttcccagcccgaagcaggagctgtctctagagggaagaattttgatgaagaaagcaatgcttccatgagcactgctagagatgaaacccgagatggattctacatggaggacggagatccttcagtagctcagctccttcatgaaagaacatttgccttctcgttttggcctaaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatcactacgtctcctcagttgtcaaaggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtctcaacaccagtgtctgatgcctttaagactcaaatggaactgctccaagcaggcctttcgcgcacacccacaaggcatctccttaatggctccctagtggatggagagcctcccatgaagaggaggcggggaaggaggaaaaatgtggagggacttgatctgcttttcatgagccacaaacggacgtcattgagtgcagaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccagtgagtattgcagagtttagagttggaaggaatcttgcaggccggtccacttcattcccttacaacatagaaatccctgacagctggtccctctgccttttccttgaatgtttcctggtctcaaacatttcccaggtctttgttgttgaatcttcttcattacagatactagcttcaggtctgtcttactgaaggcagccttacagttatttgaagatgcgcgttatgcatttccttactgtttgcttctcccat

SEQ ID NO: 321811 - DNA, 478 bp, Homo sapiens
atggcttgtttctgcagcttaaaagggagctctctaagccttaactgagtttgcgagcttatatttcactggccttgcttagaaataagatagctgctgtttcctcagctctgtgcaccagtcatgaatgcttaattccttaagcttcttgttccttatttctaaaagccagcccatatagcagtactgttttggctcactgcaactctgttctgttggaatttttcaataggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtc

SEQ ID NO: 321812 - DNA, 330 bp, Homo sapiens
tactttttgtcctccagttgacttttaaacattttatgctcttttgcatcttgatggatgtatttatctagtaattttaaccagggctttgttaaaatttcttgtgacttttcttctccctccaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatca

SEQ ID NO: 321813 - DNA, 2385 bp, Homo sapiens
cggcggcggcggcggcggcgcgggggttgagtcgtggtggtgcggacgcgctcgtgctcgggaactatcggattaaacttgaatcgagtgaaattacacaaaggagcgccgcggaggaggcggcccggggacccggacaccctgaaactcaccagagacccgttcgcccccggccaactccgtgcccgtggattcagccccctggccgcagctgccgagccaactccggagcccgctctgcgttttgttttcccctcggcactaggcagcggaggagcccgaccgacccggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaa

SEQ ID NO: 321814 - DNA, 7768 bp, Homo sapiens
ctggagttcaagatttctgatgaggaggcagatgatgcagatgctgctgggagggattccccctccaacacctcccagtcagaacagcaggaatctgttgatgcagaaggcccagtggtagaaaaaattatgagcagtcgttcagtaaaaaagcagaaggaatctggagaggaggtagaaattgaggaattctatgtgaaatacaaaaacttctcttatcttcattgtcagtgggcatctatagaagatctggaaaaagataagagaattcagcaaaaaattaaacgatttaaggcaaagcagggccagaacaagttcctttcagagattgaggatgagctttttaatccagattatgtggaggttgaccggataatggactttgcacgtagcacagatgaccggggagagcctgtgactcactatctggtgaagtggtgttcacttccttatgaagacagcacgtgggagcggaggcaggacatagatcaagcaaagatcgaggagtttgagaaactaatgtccagggagccggaaacagagcgtgtggagcgacctcctgctgatgattggaagaaatcggagagttccagggagtataaaaacaataacaaactcagggaataccagttggagggagtaaactggctacttttcaattggtacaacatgcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggaacacaaagtgctgctgacgggaaccccactccagaacactgtggaagaactcttcagcttgcttcatttcttggaaccaagtcgcttcccttcagaaaccacatttatgcaagaatttggtgatctaaaaacagaagagcaggtgcaaaaacttcaagctattctaaagccaatgatgttgagacgtctcaaagaggatgtagaaaagaacttggcccccaaagaagaaactattattgaagttgagctaacaaacattcagaagaaatattaccgagccatccttgagaagaatttcacatttctttccaaaggcggtggtcaagctaacgtacctaacctattaaacactatgatggaattgcggaagtgctgcaatcatccgtaccttatcaatggtgctgaagagaaaattttggaagagtttaaagaaacacacaatgcagagtctccagattttcagctccaggcaatgatccaggctgctggcaagctagtgctgattgacaagctgctgccaaaactgaaggctggtggccacagggtgcttatcttttcccagatggtgcgctgcttggacatactggaagactacctcattcaaagacggtacccatatgaaaggatcgacggccgagtaagaggcaacctccgccaggcagctatcgacagattctccaaacctgattctgataggtttgttttcctcctgtgtacaagggcaggaggtttaggcattaacctcactgctgctgatacctgcatcatctttgattcagactggaatccccaaaatgacctccaggctcaggctagatgtcatagaataggacagagcaaatctgtgaaaatctacaggctgattacaagaaattcctatgaaagggaaatgttcgacaaggctagtttgaaactgggcctggataaagctgtgctacagtctatgagtggaagagaaaatgctaccaatggggtacaacagctttccaagaaagaaatagaggatcttctacgaaaaggggcctatggtgcactcatggatgaggaggatgaagggtctaaattctgtgaagaagatattgatcagatcctcctacgtcgaacccacaccattaccattgagtcagaagggaaaggttccacatttgctaaggccagttttgttgcatctggaaataggacagatatttccttggatgatccaaatttctggcaaaagtgggctaagaaggctgaattggatattgatgccttaaatgggaggaacaacctggttattgatactccaagagtgagaaagcagaccaggctctacagtgcagtgaaggaagatgagctgatggagttctcagacttggaaagtgattctgaagaaaagccctgtgcaaagccacggcgtccccaggataagtcacagggctatgcaaggagtgaatgtttcagggtggagaagaatctgcttgtctatggttggggacggtggacagacattctttcccacggacgctataaacgccaactcactgagcaagatgtagaaaccatctgcagaaccatcctggtgtactgtcttaatcattacaaaggggatgagaatatcaaaagcttcatctgggatctgatcacacccacagcggatggccagactcgagccttggtcaaccattccggtttgtcagctcctgtgccaaggggaaggaagggaaagaaggtgaaagcccagagcacacagccggtggtgcaggatgccgactggctggccagctgcaacccagatgccctgttccaggaggacagctacaagaaacacctgaagcatcactgtaacaaggtcctgctgcgtgtccgcatgctgtactacctaagacaagaagtgataggagaccaggcggataagatcttagagggtgctgactcaagtgaagccgatgtgtggatccctgaacctttccatgctgaagttcctgcagattggtgggataaggaagcagacaaatccctcttaattggagtgttcaaacatggctatgagaagtacaactccatgcgagctgaccccgcgctgtgctttctggaacgagtcggtatgcctgatgccaaggccatagctgccgagcaaagaggaacagacatgctagcagatggtggtgacgggggagaatttgatagagaagatgaagacccagaatataaaccaaccagaacaccgttcaaagatgaaatagatgaatttgcaaattctccttcagaggataaggaagaatccatggaaatacatgccacaggcaagcacagtgagagtaatgctgagttaggccaactttactggcctaacacttcaaccctgactacacgtctgcgccggctcattactgcctatcagcgcagctataaaaggcaacagatgaggcaagaggccctaatgaagactgaccggcgcagacggcggcctcgagaggaagtgagagctctggaagcggaaagggaagctattatatctgagaagcggcaaaagtggacaagaagagaagaggctgatttttaccgtgtggtatccacctttggggttatttttgaccctgtgaaacagcaatttgactggaaccaatttagagcctttgccaggcttgacaaaaaatctgatgagagtttggagaaatacttcagttgttttgtggccatgtgtaggcgagtatgtcgaatgcccgtcaagccagatgatgaaccgcccgacctctcctccataattgagccgatcacagaggagcgagcctctcgaactctgtaccgcattgagctgctacggaagatccgcgagcaggttctccatcacccccagctgggagagaggcttaagctctgccagccaagcttggatctgccagagtggtgggagtgtggacggcatgaccgagacttgctggttggtgctgctaaacacggggtcagtcggacggattatcacatcctcaatgaccctgagttatccttcttggatgcacataaaaactttgctcaaaacagaggggcaggtaatacatcttccttgaacccactggcagttggatttgtccagactcctccagtcatctcatctgctcatattcaagatgagagggtactggaacaagccgaaggcaaagtggaggagcctgaaaacccagctgccaaggagaaatgtgagggcaaagaagaggaagaagaaaccgatggcagcgggaaggagagcaagcaggaatgtgaggcagaggccagctctgtgaaaaatgaactgaaaggtgttgaggtcggcgcagacactgggtccaaatctatttcagagaaaggttccgaagaggatgaagaggaaaagctggaggatgacgataagtcggaagagtcttcccagcccgaagcaggagctgtctctagagggaagaattttgatgaagaaagcaatgcttccatgagcactgctagagatgaaacccgagatggattctacatggaggacggagatccttcagtagctcagctccttcatgaaagaacatttgccttctcgttttggcctaaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatcactacgtctcctcagttgtcaaaggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtctcaacaccagtgtctgatgcctttaagactcaaatggaactgctccaagcaggcctttcgcgcacacccacaaggcatctccttaatggctccctagtggatggagagcctcccatgaagaggaggcggggaaggaggaaaaatgtggagggacttgatctgcttttcatgagccacaaacggacgtcattgagtgcagaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccaaagaatgcagatgtgctgttttcctcatttcagaaaccgaaacagaaacgacatagatgtcgaaaccctaataaattggatataaacactttgacaggagaagaaagggtgcctgttgtcaataaacgaaatgggaagaagatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgcagagatgtaattatagaatgtagtatatagggaaactggtgttcactctattttttttgtattcgcaatagatgcaaatacagcattctggcttttg

SEQ ID NO: 321815 - DNA, 4000 bp, Homo sapiens
ttgggctccaactcaagtgcgagcgggcgatgggcgcgcgggcgcggggcggctgagcagcggcggcggcggctcggggacggcggcgacccccgcctcccgcccccgcctcccgctccggaccgaccacgccgcgctcgccgggagctgcggccgcaccggcgcgaacaaagtgcgttcctcccggcgcggcggcgccagcccgcgcggggaccgccaccgagcgaggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttggatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgca

SEQ ID NO: 321816 - DNA, 3516 bp, Homo sapiens
ggacgcgtgggtcgacccacgcgtcgatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttggatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgca

SEQ ID NO: 321817 - DNA, 773 bp, Homo sapiens
tgtcgctctagaggtccctggcaggctctctactcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaa

SEQ ID NO: 321818 - DNA, 393 bp, Homo sapiens
tattaactcatacagttacttgtcttctggtttgttgattgattagaattgcaataaaagaaaagcttgcatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattca

SEQ ID NO: 321819 - DNA, 365 bp, Homo sapiens
  misc_feature (33)..(33): n is a, c, g, or t
  misc_feature (39)..(39): n is a, c, g, or t
  misc_feature (44)..(44): n is a, c, g, or t
  misc_feature (54)..(54): n is a, c, g, or t
  misc_feature (325)..(326): n is a, c, g, or t
ggaggtagaggagggccaggggaagggaagggnaggaanaaaancctactcgcnaagcacctcaaggacgttttgttctgaagactctcatattcagctctgggaaataattatttctctgattatcccttcaacttttgaagattaccagatttctcaacagcaatactgtggtctggaataaaagggggcacttccctcagactttggagaagacattattttgaactagaattctgtctacagccatactctcaatgaagtaagatggcagaataaagatgtcatggcctcgttggcctcagcggtggagctctgcggccgnnaattaatattaatattaataatgagcaatggagcacaac

SEQ ID NO: 321820 - DNA, 661 bp, Homo sapiens
aaaaaaactttattgtagatatatgcaacctctaggctcattttgacccctacctcatctttttaatgcccatcatcttaatgttgtatctggtttgcctttgatgcctagaagaagaaaaaaatctttgcatttactaaagaaaacagttactccctgagtaagatcaagtgtttgatctgggaccttataaggaagttctcaaagaatggtgatcttggtattgaagaaagctgattttcatctcattagaaggtaatctttgcagaaaaagtaaagccggtgccttcattcctaacccccagattttcctattttgtaaatcccaagctatggagttcattagagcttttacaactcactagaactcatgagttcagtagctttagacagttaaatgcagctgagaacctgccttgggggcccagaaagaattcctaggcttatgggaatgttttttgttttgtttttctcccttaaaggagcagcaagcaagtaacacacttctttcaaaatcttcagagcctcacctagttacctatttcttaaccattgctttaagttatataaacatattcatcctttttatgtctgtgtctttcaaataaatatgtaagctggcagagtcctttgccttagacaccacgccgagcccccagag

SEQ ID NO: 321821 - DNA, 3665 bp, Homo sapiens
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttgtttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaatcctgg

SEQ ID NO: 321822 - DNA, 3754 bp, Homo sapiens
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttgtttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaatcctgg

SEQ ID NO: 321823 - DNA, 3496 bp, Homo sapiens
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttgtttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaatcctgg

SEQ ID NO: 321824 - DNA, 3246 bp, Homo sapiens
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttgtttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaatcctgg

SEQ ID NO: 321825 - DNA, 3705 bp, Homo sapiens
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttgtttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatacta

SEQ ID NO: 321826 - DNA, 4475 bp, Homo sapiens
  misc_feature (3762)..(3762): n is a, c, g, or t
  misc_feature (3765)..(3766): n is a, c, g, or t
  misc_feature (3843)..(3843): n is a, c, g, or t
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttgtttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaatcctggaaaaaaanaannaaaaaaaaaaaaaaaaaattgggggggggcggggcccggaaaaggtttttaaaaaaatgccggttgtgggggcgcgngggggcccgacatggtcaagtgcaccgagtggtcaaagacgcggtcccaaaggaaaaactccggcgtcatggcacagagcgccgggacttccttcacacattaaaaaaaggcgcgggggcgcaaccgagtcgctcctgaaacaacctccagagggagtttcggaggccccatcacgcgggctcctcaaccacgagggggttccaaagcgagtcgaatataaataacgcccggcctcagggacaacgagaaaccgggagcaacaacaaaacagaaaaacggacaaagggaaccacaaaaaaaagaagaagataagaaccaagaaacgggagaggaaaccaagaacagctccgccgtagctaacaaacatcgcacacgagccaaaacgggcgcgataacggtccaaaggcacagtagaacaaacggaacaccaacgagcatggggcagacaaaccatcctgacccattagaacacggggacgggctactcaactacctgcaaaggcgacatcaggcaacacacacaaccgcgcactgaagagacagaacacaaacgaacggacatgcagccagagacaagaaagaaagaaagaaaccaagacaagatagaacaagatgacagaagacaaaagag

SEQ ID NO: 321827 - DNA, 3745 bp, Homo sapiens
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttgtttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattctgtggagtgattggtgtgttggcccctcccatgccccattaatttaattcctccgggcaaaaaaaatataataaaaaa

SEQ ID NO: 321828 - DNA, 3751 bp, Homo sapiens
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttgtttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcatttataaatatttttttttctttattcgctttttttctcttttctctcccatttttttttttttcaataaaagttttctttca

SEQ ID NO: 321829 - DNA, 3847 bp, Homo sapiens
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttgtttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggaaagtacctcttttacagaatgccgatcctgtaaagctcaaggtctgaaccccataaaaactctctattgtctctaagaattggaggtcggaactaaattgatcaatgtgcattgtcctttaactccaccctccaagcaatgataatataattatcgtagctaataattctttttagtcctgtaatatgtcagtgaactatatcatatatggttcaatgtggtagtgtgcaatttctgtgagaatatataatgcagttttactggactgttgtggacgtcaggtggaatttacgtaatacatggaaaagtaatagggattattttgaactccacagtaaataggtcttcctttcagaaag

SEQ ID NO: 321830 - DNA, 3587 bp, Homo sapiens
  misc_feature (3126)..(3126): n is a, c, g, or t
  misc_feature (3137)..(3137): n is a, c, g, or t
  misc_feature (3164)..(3164): n is a, c, g, or t
  misc_feature (3179)..(3180): n is a, c, g, or t
  misc_feature (3182)..(3182): n is a, c, g, or t
  misc_feature (3188)..(3189): n is a, c, g, or t
  misc_feature (3197)..(3197): n is a, c, g, or t
  misc_feature (3226)..(3226): n is a, c, g, or t
  misc_feature (3236)..(3236): n is a, c, g, or t
  misc_feature (3239)..(3240): n is a, c, g, or t
  misc_feature (3270)..(3270): n is a, c, g, or t
  misc_feature (3293)..(3293): n is a, c, g, or t
  misc_feature (3317)..(3317): n is a, c, g, or t
  misc_feature (3321)..(3321): n is a, c, g, or t
  misc_feature (3327)..(3327): n is a, c, g, or t
  misc_feature (3332)..(3332): n is a, c, g, or t
  misc_feature (3359)..(3359): n is a, c, g, or t
  misc_feature (3385)..(3385): n is a, c, g, or t
  misc_feature (3411)..(3411): n is a, c, g, or t
  misc_feature (3437)..(3437): n is a, c, g, or t
  misc_feature (3453)..(3455): n is a, c, g, or t
  misc_feature (3460)..(3460): n is a, c, g, or t
  misc_feature (3466)..(3466): n is a, c, g, or t
  misc_feature (3475)..(3475): n is a, c, g, or t
  misc_feature (3487)..(3487): n is a, c, g, or t
  misc_feature (3489)..(3489): n is a, c, g, or t
  misc_feature (3509)..(3509): n is a, c, g, or t
  misc_feature (3516)..(3516): n is a, c, g, or t
  misc_feature (3544)..(3544): n is a, c, g, or t
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttgtttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggaacaanccaaggacacnacccccctaagggaggcagcccccccnccccaaaaaaggggnnanaaaaanncaagagancaaacgccccccaaagcagcaaaccccanccaaaaaaanaannaaaaaaaaaaaaaaaaaacaacccaacaancaaaaaacagaaaaacaaagcanaaaaaaaagcaaacaaaaaaaaancaanggaaanagaanacaaagccatgaggaaagaaagcaganaacagcaaacagaaaaagaggaactnacccaagaagaaggcaagaagagganccagaaagcgaagagcggaaaagaanacaaaagaaaacaaannnaaaanaaaaancaaagcaanaaaaacagaggncnaaaaaaaaaacaccgaaagnacaatanccaacactatgaagaaaaaaaaaagcanacccaataaagagaacaagtttgcccagaattagtaaaaataa

SEQ ID NO: 321831 - DNA, 2878 bp, Homo sapiens
  misc_feature (2838)..(2839): n is a, c, g, or t
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaacctcaaggacgttttgttctgaagactctcatattcagctctgggaaataattatttctctgattatcccttcaacttttgaagattaccagatttctcaacagcaatactgtggtctggaataaaagggggcacttccctcagactttggagaagacattattttgaactagaattctgtctacagccatactctcaatgaagtaagatggcagaataaagatgtcatggcctcgttggcctcagcggtggagctctgcggccgnnaattaatattaatattaataatgagcaatggagcacaac

SEQ ID NO: 321832 - DNA, 3242 bp, Homo sapiens
  misc_feature (3202)..(3203): n is a, c, g, or t
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaacctcaaggacgttttgttctgaagactctcatattcagctctgggaaataattatttctctgattatcccttcaacttttgaagattaccagatttctcaacagcaatactgtggtctggaataaaagggggcacttccctcagactttggagaagacattattttgaactagaattctgtctacagccatactctcaatgaagtaagatggcagaataaagatgtcactagcagtgaatggctttactttccacacacccatcctgaaaacactctgcaagaatagagaacaaatccagtaataaaattaaatctcaggatttctaggtctgaagccaacctagaaggcattctatccaaattagaacaaacaatgagagatttttagaacaactgtttacaagaagcatgattaaatggataccattcaatagcaggaagataccatgcattcaaaacattttttatcgagcattatgtgcccaggtactgtttagacactgaggatacagcagtgaacaaatttcttaagcctccaagagtttttattctagtggggggatgcagaaagacattaagccaaataaagtgtggcctcgttggcctcagcggtggagctctgcggccgnnaattaatattaatattaataatgagcaatggagcacaac

SEQ ID NO: 321833 - DNA, 3084 bp, Homo sapiens
  misc_feature (3044)..(3045): n is a, c, g, or t
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaacctcaaggacgttttgttctgaagactctcatattcagctctgggaaataattatttctctgattatcccttcaacttttgaagattaccagatttctcaacagcaatactgtggtctggaataaaagggggcacttccctcagactttggagaagacattattttgaactagaattctgtctacagccatactctcaatgaagtaagatggcagaataaagatgtcactagcagtgaatggctttactttccacacacccatcctgaaaacactctgcaagaatagagaacaaatccagtaataaaattaaatctcaggatttctaggtctgaagccaacctagaaggcattctatccaaattagaacaaacaatgagagatttttagaacaactgtttacaagaagcatgattaaatggataccattcaatatggcctcgttggcctcagcggtggagctctgcggccgnnaattaatattaatattaataatgagcaatggagcacaac

SEQ ID NO: 321834 - DNA, 1180 bp, Homo sapiens
gcagtagtttaatacactcatatatcatccatgtcactgattcaccagtgatgtgatgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttgtttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgccaataaaatcaagaaataagaaaactacaaaaaaagatacggtattaaccttggacataattttttttagggaggcagctttcccacttttataaagggggttgtaaatctcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaatcctgg

SEQ ID NO: 321835 - DNA, 2854 bp, Homo sapiens
  misc_feature (2814)..(2815): n is a, c, g, or t
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaacctcaaggacgttttgttctgaagactctcatattcagctctgggaaataattatttctctgattatcccttcaacttttgaagattaccagatttctcaacagcaatactgtggtctggaataaaagggggcacttccctcagactttggagaagacattattttgaactagaattctgtctacagccatactctcaatgaagtggcctcgttggcctcagcggtggagctctgcggccgnnaattaatattaatattaataatgagcaatggagcacaac

SEQ ID NO: 321836 - DNA, 2777 bp, Homo sapiens
  misc_feature (2737)..(2738): n is a, c, g, or t
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattcataaggcattcattctgttgtaaatgttcaatatatttattttgagagcaaggacctgtggttgtaaacaggtgtggttacaggtgtggttatgtatctgagtgttgcggtcatactctcctccagtccaatcctgagcatcttcatcttattaattagctgttcgtttctttgtgcactcattcttttatttttacttctttttaatgttatggtatccagttgtttccagtagcagtttcttgaacttctggcctgtactactaactgcagacctccagagtcactggcctttctgtgctctacatattattttaggggccacatcagttgccaagagcaacatacataccgacctggctgaattattgccagtgaaaacaacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaacctcaaggacgttttgttctgaagactctcatattcagctctgggaaataattatttctctgattatcccttcaacttttgaagattaccagatttctcaacagcaatactgtggtctggaataaaatggcctcgttggcctcagcggtggagctctgcggccgnnaattaatattaatattaataatgagcaatggagcacaac

SEQ ID NO: 321837 - DNA, 1648 bp, Homo sapiens
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaaggtatgagacccacaagcacaatgatcatttttatttgtttgtttgtttgaaacttcagcagaatagatatctgcatgctttatgaagttgttgcttcggtaagagcccatgggatgccagaaattaacatttctttgctgccatgggctgatgatgctgctattagataaagtttagctgtggcaccaagtcacatcattttcatagaaaaagattacttgtagcttattttagaagtatgaccttttggtctgtttgattgattgattagaattgcaataaaagaaaagcttgcattca

SEQ ID NO: 321838 - DNA, 2124 bp, Homo sapiens
  misc_feature (2084)..(2085): n is a, c, g, or t
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcagttagctccattcagaaccaaatgcagtccaagggaggttatggaggtggaatgcctgccaatgtccagatgcagctcgtggatacgaaggcgggatagccctggtcctttctccaggttattgtgaatttctatattttctctgtccactattctgtaatttttttttgtcctgtgattgcttttattttgaattacaaaaaagaagtgtgatggcaccttgtccaccctgtcgtgattattccagtgagatgttactgttctgctctgaagaagatactgtcagacgaatcctgcatttccttcagctggcatgcatgcctttggactcatggacagagttctttggattgtcactgaattttcaatgtttaatcagtatggatctgatcttcgcatgatcttttttgtgaatgctaacaccattttgcagttttttttttctattttaaacatttttcttttcactgccgaccccctgccttacgattttattggaaagcaaggacctgctattatttgttaatttgccatcatttatgtatattttggaagttttgagcctttgtgtcaatcccaagcacagagaggatctgccaaggaaaaacatttgcatcttcggagtagacattttgcagtttgtttaataacaacttctaaacctcaaggacgttttgttctgaagactctcatattcagctctgggaaataattatttctctgattatcccttcaacttttgaagattaccagatttctcaacagcaatactgtggtctggaataaaagggggcacttccctcagactttggagaagacattattttgaactagaattctgtctacagccatactctcaatgaagtaagatggcagaataaagatgtcactagcagtgaatggctttactttccacacacccatcctgaaaacactctgcaagaatagagaacaaatccagtaataaaattaaatctcaggatttctaggtctgaagccaacctagaaggcattctatccaaattagaacaaacaatgagagatttttagaacaactgtttacaagaagcatgattaaatggataccattcaatagcaggaagataccatgcattcaaaacattttttatcgagcattatgtgcccaggtactgtttagacactgaggatacagcagtgaacaaatttcttaagcctccaagagtttttattctagtggggggatgcagaaagacattaagccaaataaagtgtggcctcgttggcctcagcggtggagctctgcggccgnnaattaatattaatattaataatgagcaatggagcacaac

SEQ ID NO: 321839 - DNA, 1099 bp, Homo sapiens
  misc_feature (1059)..(1060): n is a, c, g, or t
agcgggggggcgcgcgccgcctctcgctccgcccaacccgcgcgcgagcctgggcggggagggggagccaggaagctgcgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataaaatttcatcttggcatcactggacatcatcgtattgaggagcgtatttttggaacttcccgagttgagatttggaaccttcattggtgctcatttactgtggactgtaagcatgagtgaattctggttgtgtttcaactgctgtattgcagaacagcctcagcctaaaaggcgacggcggattgacagaagtatgattggagagcccacaaactttgtgcatacagctcatgttggatcaggagacctgttcagtggaatgaattcacctcaaggacgttttgttctgaagactctcatattcagctctgggaaataattatttctctgattatcccttcaacttttgaagattaccagatttctcaacagcaatactgtggtctggaataaaagggggcacttccctcagactttggagaagacattattttgaactagaattctgtctacagccatactctcaatgaagtaagatggcagaataaagatgtcatggcctcgttggcctcagcggtggagctctgcggccgnnaattaatattaatattaataatgagcaatggagcacaac

SEQ ID NO: 321840 - DNA, 359 bp, Homo sapiens
  misc_feature (33)..(34): n is a, c, g, or t
  misc_feature (48)..(48): n is a, c, g, or t
  misc_feature (319)..(320): n is a, c, g, or t
aggtgtgagctggaaaagggaggaaaaggctgnncgagtcatctactncgaagcctcaaggacgttttgttctgaagactctcatattcagctctgggaaataattatttctctgattatcccttcaacttttgaagattaccagatttctcaacagcaatactgtggtctggaataaaagggggcacttccctcagactttggagaagacattattttgaactagaattctgtctacagccatactctcaatgaagtaagatggcagaataaagatgtcatggcctcgttggcctcagcggtggagctctgcggccgnnaattaatattaatattaataatgagcaatggagcacaac

SEQ ID NO: 321841 - DNA, 494 bp, Homo sapiens
  misc_feature (454)..(455): n is a, c, g, or t
aaagaatctaggaaatattcattctactgtgaaggacacagtagagggtcaggcagtccaatctgtgattaacgggagttttacaaaaagcaaggaaaatgctcttcagaggaaaaagattttaaaaaaaagtctcttgaaatttcaaaaaatttgtttttacatttatactttctcacttcacagcccctcaaggacgttttgttctgaagactctcatattcagctctgggaaataattatttctctgattatcccttcaacttttgaagattaccagatttctcaacagcaatactgtggtctggaataaaagggggcacttccctcagactttggagaagacattattttgaactagaattctgtctacagccatactctcaatgaagtaagatggcagaataaagatgtcatggcctcgttggcctcagcggtggagctctgcggccgnnaattaatattaatattaataatgagcaatggagcacaac

SEQ ID NO: 321842 - DNA, 925 bp, Homo sapiens
  misc_feature (885)..(886): n is a, c, g, or t
aaaaaaactttattgtagatatatgcaacctctaggctcattttgacccctacctcatctttttaatgcccatcatcttaatgttgtatctggtttgcctttgatgcctagaagaagaaaaaaatctttgcatttactaaagaaaacagttactccctgagtaagatcaagtgtttgatctgggaccttataaggaagttctcaaagaatggtgatcttggtattgaagaaagctgattttcatctcattagaagcctcaaggacgttttgttctgaagactctcatattcagctctgggaaataattatttctctgattatcccttcaacttttgaagattaccagatttctcaacagcaatactgtggtctggaataaaagggggcacttccctcagactttggagaagacattattttgaactagaattctgtctacagccatactctcaatgaagtaagatggcagaataaagatgtcactagcagtgaatggctttactttccacacacccatcctgaaaacactctgcaagaatagagaacaaatccagtaataaaattaaatctcaggatttctaggtctgaagccaacctagaaggcattctatccaaattagaacaaacaatgagagatttttagaacaactgtttacaagaagcatgattaaatggataccattcaatagcaggaagataccatgcattcaaaacattttttatcgagcattatgtgcccaggtactgtttagacactgaggatacagcagtgaacaaatttcttaagcctccaagagtttttattctagtggggggatgcagaaagacattaagccaaataaagtgtggcctcgttggcctcagcggtggagctctgcggccgnnaattaatattaatattaataatgagcaatggagcacaac

SEQ ID NO: 321843 - DNA, 469 bp, Homo sapiens
gctgtattgcagaacagcctcagcctgtaagtatgaagtatgtggacacatcaggtggggtgcttattaaactttccactggttctcaaactgaggattgggatcctagcagtaattgcaaagcagttgtagagaataccacagagaatagttcagtggaactccgaacatatgtttaaaaagaaataatgtttttaaagtaaatactgtatgtcaagaactctcctagaccattcatcgtacatgactgagaggaggtgttcttctgtcaaatagcttctggaggaatagtgagagaaaaaggagatagtaacctgaggtaaaacagataaatcagccttggaagtcagtgggtggaagatgtgacagccatattgccatcatattcctctcagcttaccatctcattttcctcagagcaaccctctgaggaagatatcattgtctttatttttcagttgaaacaggt

SEQ ID NO: 321844 - DNA, 468 bp, Homo sapiens
gtgtttttttgtctcttttgtgtgatgttgttctttgtttccctgaacttttctgcttctaagtttgttgccgtttccttccattttcccaaaattttgggcgctttccttttaatcaaacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321845 - DNA, 2300 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacacctgcttctgaggtcggtggctgtctttccattaaagaaacaccgtgcaacgtg

SEQ ID NO: 321846 - DNA, 2839 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtgtgtgtgttggctcacagactctcgcgcgtggaggtgggggggtgtgccctcctctctccaaaggcgtgggtgcgccgtgtcaccttaacacttacacacatcatcgtggcgacttcggtcgcggtggaggcgggaggaagtgctgttcgtcgtcgtgtagggggcgagcacacacgccgccgtagcacaaaaaaccacaggaggaagagcgggcctccacgagacggtgcccgtgcagcaggggcagagcccacaaagacgtagtacgtcgacccaggaaggagagtaggaaggtgggaggagcacaagaatcagcgcagcagaatgaaccaccaatcaacgcggagagagtcacagagaagcggtttaccctaaaaagccaacatcacacacaagtgaccacagggggggaatagtcgtctaccccattatctattcgggggaaccagcgcaaaggagggggtgctatagagagggcggggtggtgtctcctccattaaaaaaacacacgcggcaagcgtgaaacaaaacaacacaaacacacaggggggggggagaacaaagaaatacacacctagagagaagcccaacagtcagacgcgaccccaagtctatctaaggaaagacgaggagaaccaaaagaagggagagcgaaaagaaaaagacaagagaggagctgcgacaaaaaaaaagaacgcgggacgcgggaccaacacaggcacacagatcgatcatgaggacaacgagcacaatcatgggggggcaggcaataatggagacagcccacacagcaaaattaacagcctagaggaataataacattagcactaatatggataacccagcgactattatgcgcaaaaacaatgacacgatagtaaacagatcag

SEQ ID NO: 321847 - DNA, 2358 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321848 - DNA, 2240 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtgtcttgtgctcatctaaacacctcgctcggtcttctagagacgtggggaggaagcatgactcacctccatctctcctgaaatactcgagcataccgatcgtcgtcctcattttcacataccacaacctctcagtgtgctcttcgtacgctctaagaagcgatagggacgttgttcttagtcgtcgtgagcgggtcgtagcaccacgagccctgtgccgcacaaataccaccgagaaggagagaggtcctcccccacagcgtgccgcgctctcacgtcttcatgacgagccac

SEQ ID NO: 321849 - DNA, 2056 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321850 - DNA, 2011 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacagctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321851 - DNA, 1849 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgcccacagttcctgcctcccaagatcctctaata

SEQ ID NO: 321852 - DNA, 1410 bp, Homo sapiens
ctgccttgagattacccggggcccccccccgagtatggattcgcgaccacgccgtcgggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321853 - DNA, 1694 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321854 - DNA, 1581 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggttctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321855 - DNA, 851 bp, Homo sapiens
gagagagaagaaggacggggaaagagagaacagaagggaggactggtcgaaggcaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321856 - DNA, 1195 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacagtgggcctacggtcctctgccatcgccatctcaccgcatcgcaccaacagactgtggttcctagtgatgtggactcacctcggaggtatccgagctggacacagcccctggacagtgatccagacagctggccgtccctccaaggagcctgtcacctgctgcgagactccagttcctccccatcccgcagagacctcttgtgttcctgcctacatagtttcccagggtttaagtgtgcctggcatt

SEQ ID NO: 321857 - DNA, 978 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccactaggtctccccttatccttctggtccagcgcaaggaggggctgcttctgaggtcggtggctgtctttccattaaagaaacaccgtgcaacgtg

SEQ ID NO: 321858 - DNA, 734 bp, Homo sapiens
aaaaacactctggcagggtgcggtgtcacatgcctgtaaaaacaacactctggcaggccaaggcaggaggatctcaaggtcaagagattgagagcatcctgggcaacatggtaaaagacactcactcctaaaaattcaaaaaaaagtttggcttggtggtgtgcgcctgtaaacacagcaaggttaaaagctccgggccgagagaccttaacagtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321859 - DNA, 575 bp, Homo sapiens
aacagtagatgctgatggtatcatagtacaaagtctcagacttcatacaggaatgctgaattcagtccaggaaaaaaatgtgcacgtatatgtgaattcatgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321860 - DNA, 845 bp, Homo sapiens
  misc_feature (785)..(785): n is a, c, g, or t
  misc_feature (801)..(801): n is a, c, g, or t
  misc_feature (818)..(818): n is a, c, g, or t
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggccgggaacccacttggaaaacaatggcttttgnaccctggaacccttcnaatgggcctgaagcttnaaattaccctggggcaatttttaaaaa

SEQ ID NO: 321861 - DNA, 2384 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321862 - DNA, 2855 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtgaaaaaaaaaaaaaaaaacaaaaaaaaaaaaaaaaaaaaaaaaaaaaaaaaaaaaaggggggcccaaatcccctgaggggccccaatttaagcgtcacccagtttttttgaaaaaaggggccccccatagaggagctgctttataaacagcacacagaccggccccgcgctttaaaaaacaggcgctctaattgggaaagaacctgcgtacctgcaggtcgaactcttgtggagaaggaaccccccacaacctccggggggggacacaataatggtgggcaccaaccacccatcaggagaaattaaaagcccccggggcaaattaacaacttggaggtgtctaatggtggtgtcacccaacggcgcaattcttgcggcgtgaaacaacttcgcaccagagctatatgattgtacgagcacatttttctcgcgggacattcattgtaatacgagcactatcatcatactagct

SEQ ID NO: 321863 - DNA, 2355 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgcggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321864 - DNA, 2331 bp, Homo sapiens
  misc_feature (2331)..(2331): n is a, c, g, or t
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtgtgtgtcgtggctccacagatctctcgcgcgtcagcgcggggggggtgctctctctatctctcgatgtggcgcgtgtgtctcttatcataccacaccactctctgtctgttcttgcgcagggcgtgggagtgtgtgtgtagtgtcgggcgctaccacccagccggtgcacacaaccccctgggaggcggtccccccgatgtctgtcttgttgtggctccccccactttgtcgggcccggaggcgtgggggcgtgggacgcgccatctccggggaggcaccatcccgcgagccccagcgcgggttttaagagccccccccgggcccggggtggcccccttcttgcgcccggggggcctccgcgggggtctccacacgcgcgaan

SEQ ID NO: 321865 - DNA, 2162 bp, Homo sapiens
  misc_feature (1952)..(1952): n is a, c, g, or t
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcccnctctcccgctcctctctaccctttttgtttttgggctttggggcctggcccctccttttctctgtccctgtcgttgcctttcccttttctgttaatgtttggcctttctttttcattttgggtgtttttttttggtgtcttccttgtaccagaccttgccataaataacttaggaaaattatctacacaattttaacattataattataa

SEQ ID NO: 321866 - DNA, 2435 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321867 - DNA, 1815 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcctctccccagcctgccctgctcaggccttgcccccaaacctgtactgtcccggaggaggttgggaggtggaggcccagcatcccgcgcagatgcggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321868 - DNA, 1663 bp, Homo sapiens
  misc_feature (1502)..(1502): n is a, c, g, or t
  misc_feature (1513)..(1513): n is a, c, g, or t
  misc_feature (1520)..(1520): n is a, c, g, or t
  misc_feature (1537)..(1537): n is a, c, g, or t
  misc_feature (1549)..(1549): n is a, c, g, or t
  misc_feature (1607)..(1607): n is a, c, g, or t
  misc_feature (1637)..(1637): n is a, c, g, or t
  misc_feature (1641)..(1641): n is a, c, g, or t
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggccgtcgctgtnaggcgtaaggnacatganttctagggtctcctttntccttatttatncttgtggctacatcatccctggctgtggatagtgcttttttgtagcaaattctccctncttaaggttatagggctccttgagtttggnagtnttggaagtactactttaacttg

SEQ ID NO: 321869 - DNA, 1789 bp, Homo sapiens
  misc_feature (1579)..(1579): n is a, c, g, or t
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacagctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcccnctctcccgctcctctctaccctttttgtttttgggctttggggcctggcccctccttttctctgtccctgtcgttgcctttcccttttctgttaatgtttggcctttctttttcattttgggtgtttttttttggtgtcttccttgtaccagaccttgccataaataacttaggaaaattatctacacaattttaacattataattataa

SEQ ID NO: 321870 - DNA, 658 bp, Homo sapiens
gcgcgcggcccccgcgagagcttataccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 321871 - DNA, 933 bp, Homo sapiens
cagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcaggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagaactccttaaaccttatgaatccactatacccaaaaaatccgggcttcaaatggggacgtggttcctatcccaagcg

SEQ ID NO: 321872 - DNA, 2994 bp, Homo sapiens
  misc_feature (514)..(514): n is a, c, g, or t
  misc_feature (531)..(531): n is a, c, g, or t
  misc_feature (688)..(688): n is a, c, g, or t
aggatatcctcgcttctcattctatcctgatgtcaattctggagtatttgccagatgattatatgttttgtggattatctatacattggacatgaatctttttcttttcaaagaagagaactttttggtcactaagtgcagtgtctctcatttgggagttaggctgagggagggtttatttccttgggaatatttcttgattttaatattaaatgcccacagtacagagatttattttgttctcttcgatgggatggaaaatgttgaagtgactttgtcttaaaataattaagtggattttaaccatgttacttttaaacttctgtttcactttagagaagatttttcaagagtctttgaacactttgaactattctgtatttaacatatcgttactcctctttaaataattatgcctgttgagaatgttctctcaaagaaagtactgcagtattttggtagtagtatagtctggtgttgcattaatattaagcatgcatactcggcagactanaatgttaataagccgtngaatatttcctttaatgttttaaattgttcaaagcattggtgtaacattgatggagtaattttagatagagcattttaacttaggtaatacagaagaaacactgcaaattttagacaggtataactgaaaacagtaatacttgaagacatcctttcngaaaatggtgtgtctgttaacaataaggcagaaaaggtattgtgggcagaagaacaaatcttagcctacctagctggcatgccagttaaaggcagtgagccttcacacaaactatgtggtcctttaaattataataaaaatagagacaagtcacttcacatagttcattctattttcttttcaatttattattacttgcccaaagctaaggagggaggaggagagagagagagagagagagagagagtgtgtgtgtgtgtgtgtgtgtgtgtgtgtgtgtgtcactatacactaggcttgacataaaagtagtttgggaccatcttaatttaaagagtaacataatttaggaagccatcatgtcaacttatttttcatatatgtgtatgtacacatacacacattcatatatatgtacgtatctatgtgcacatgtatgtatgtgtatatatgatatatttgaaggaaaatttttcttttatttcttttgtttgttttaggttgtttgcttttactcttttcttttgtgcatgagtgtgtgtttggatatgtttcttactattatttgtgaaggttccattaaacacttttactttattacctctagaatttatttttcccttccttttccacctcagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321873 - DNA, 554 bp, Homo sapiens
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321874 - DNA, 1391 bp, Homo sapiens
  misc_feature (878)..(878): n is a, c, g, or t
attgtttttagagatggggtcttgctgtgttgtctgggccggagtacactgggtactcacagatgtgatcattgcatactacagccttgaactcctgggctcaagtgatccttctgtctcagtttcctgagtacctgggactagaggtgtgtgccaccatgctggttatctataagcacttttacatttatttatttatttaattcttgtagtaactctttgtggtaggtactattatcctaagtatcctataagaaaactgaggcactgcagtttgaagtaacttgctcagggtcactcagccaattaatggtggagcagcggtttgaacccaggctgtctagttccagagcctatagccataactactgtcttatattatccctaagaatatgtaaacgacgtcaaaccccgatcctatttgcattcccctccccacgggtaactatcttgaatcagagccaatactacactattgcattagggtataatttaatcattaggggatagttttcatgcagaaactagaaagcactgatgagattctactcatgttcctttaccagctttagttataaaggggaagcgggaaaatggaagcacgtagaggataaggtgataacctccaccttaccatcttccttcttcccccttaaaaaagaaatggaatgttgagtctatctggaatgttgacaggttaaaaaggagctgttgaagcctgtcgttcacagtagcatcgaaaggtgaaaatttgtctccacttgagtaccttgaaatggcaggtgtgttattggaatattgggctattgttggtcagtactgctgagtatagacttttgtaggtgtttatcctgaatctgtagtgaccggaatttcancaaatgaggtatttaatactgttttttcccttttgtttctgaaaggagcagaggatagaaagacaattgttctagcctcaagtcccagtacactcattagttaagtgtgacggtggtcaagtgatgttgctttgtgtgtctgttttctcttaggtggttcaggtaccctgaaataaatcctaacttatatgtctgttgctcattcatctctgtgtgtggagaaagtgatttaaagtgtcctttctttaagaaggaaagagccagggcatagtggctcgtatctgtaatcctagcactttgggaggctgaggcaggaggattgcttcagtcaggaggttgagactggcctgggcaacatagtgaaaccatgtctctactaaaaaaaaaaaaaaaaaaaaattagcttcggagactgaggcgggaggatcccttgaactccagagatggaggctacagtgagctatgatcttgccactgcactccagccttggtgacagagtcacacactatctc

SEQ ID NO: 321875 - DNA, 920 bp, Homo sapiens
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaaaaaaaaaaaaaaaaaaaaaaattttggggggggtggggcgagaaaaggtttttcacacccctcctggtggggcgcgccgcggccccagcaggtaatgcggcacatggggcaccacggcgccccaaagaagacaccgtgcggctagaagatgcgggggagttctcccccccaaaaaaaaagggcgccggcggcacgcgaggtgcatggacacatcccagagggtgccggacggctacacgggtccaaccacaggtccagcggtcgctacccccgcgccggccgcggcgggaaaacacaaaccacacacaacacacacaaacagccgaccacaagaccacacgccgacaacagcgaacacagcaacgg

SEQ ID NO: 321876 - DNA, 512 bp, Homo sapiens
tctgtcagaattctcatcttttctttcattttatgctgttctgttgttctttcttgtgtaacctttcctttcttccaataggtcactgctgtctgttctgacttattgctaattctttgctcttccttttctgacctctctagagcctagaagaggagataacatcaattttgtttagtgaaaagggcttttctgatagcatgaaagccaccttcacttcagccaccacttggacagcagagggcgctgttgtgagcgctaatgcaccttctgaaaagctttcttcctcgcccttctcacacttgcttgaggtgcattttactttgtttcccctgttactaaaagccacatatgagagagattttcatttttttaaatattcaggcaccattccctccagtgctttcattggtgaaattaattcttcctgggagaaacattcaagaaacaatgactgaattggaacatgaagaaaagatatagattggatgtttctcctgcttctttggtca

SEQ ID NO: 321877 - DNA, 4350 bp, Homo sapiens
gctcggtacccggtgtttatcgatgccacagcttttgtttcaggaaagccctgagcagaaacataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321878 - DNA, 4389 bp, Homo sapiens
aggattgtttgagcccaggaggtcgaggctgcagtgagccatgagtgtgccactgcactccagcctgggtgacagggtgagaccctgtctctgaaaataacataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321879 - DNA, 4640 bp, Homo sapiens
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagcctagaagaggagataacatcaattttgtttagtgaaaagggcttttctgatagcatgaaagccaccttcacttcagccaccacttggacagcagagggcgctgttgtgagcgctaatgcaccttctgaaaagctttcttcctcgcccttctcacacttgcttgagacacgtgctcccgagtcagaagggccttgcactggagccagggatgctgttaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321880 - DNA, 4013 bp, Homo sapiens
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321881 - DNA, 3201 bp, Homo sapiens
agcttttggacgctggatttccatcagctttccacagttttccaatgacaggaaatagcagacagcgggcttgatgtgcttaaaagctgcaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321882 - DNA, 2984 bp, Homo sapiens
cgttcgaccttgtggctctgcgtcgaccttctgctctgcgtcgaccttctgctctgcgtcgaccttctgctctgcgtcgaccttctgctctgcgtcgaccttctgctctgcgtcgaccttctgctctgcgtcgaccttctgctctgcgtcgaccttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321883 - DNA, 2477 bp, Homo sapiens
aaagaaaaccagcaaaaaataaaagtgccatctccttggtgctgtgttcatttaagaatcagcgttccaggctagactttatagtctgattaaaaccaaaactgttactaggttttaaaagttaaatttttttctttaaaatgatgagtcagctttggtataattcaatttttgtaaactgttttaactacataggtagagcttataggtatatctataataaaagcattttacttctttgggaggatgctggctgtttttgtgtctttttgtaagctttttggcatttgtcttgattgtcctctatgtgaccttgagcagaggtttctgtagatgttgattcttgctgttttgtctttgcagtgtcagatgtttgtttcagtggttgttgaggtaaaactgtattgattttgtgtcctcggttgctttttgttctgcagacacgtgctcccgagtcagaagggccttgcactggagccagggatgctgttaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321884 - DNA, 2404 bp, Homo sapiens
  misc_feature (1)..(1): n is a, c, g, or t
  misc_feature (5)..(5): n is a, c, g, or t
  misc_feature (14)..(15): n is a, c, g, or t
ntgtntaaaacaanngagaaaaggagaccatcttttcaaggatattttatccgtgaaggagaagtacctgatgccgacaatatggacagttgaagaaaaagctcaggagacggacaagacacgtgctcccgagtcagaagggccttgcactggagccagggatgctgttaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321885 - DNA, 4454 bp, Homo sapiens
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaatttattctctaaactaaaaacttctctttttctaaa

SEQ ID NO: 321886 - DNA, 2074 bp, Homo sapiens
ggcgaagatggaagaagaggaaacgcagctggaagaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagcctagaagaggagataacatcaattttgtttagtgaaaagggcttttctgatagcatgaaagccaccttcacttcagccaccacttggacagcagagggcgctgttgtgagcgctaatgcaccttctgaaaagctttcttcctcgcccttctcacacttgcttgagacacgtgctcccgagtcagaagggccttgcactggagccagggatgctgttaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321887 - DNA, 4362 bp, Homo sapiens
  misc_feature (4218)..(4218): n is a, c, g, or t
  misc_feature (4224)..(4224): n is a, c, g, or t
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttttntttccntatatttttccccgttgaggccggccccagaagccccaaaggggcttataactttttggaacatttttaccatttacttggccccattttttgttcctttttttttacattttggggcccctaaatttaaataaatga

SEQ ID NO: 321888 - DNA, 1450 bp, Homo sapiens
aggtgatcagtgtgtgtgtgttttgccattgtgaggtggaggctgttccccagctcacagccgttctctgtcctgaccctggcaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321889 - DNA, 1344 bp, Homo sapiens
gttcgcctgctggtcagtgtggatgaggctgactatgaggctggccggcgccgcctgttgctgatggaggaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321890 - DNA, 1439 bp, Homo sapiens
aaagccaacatgtttcctctacgtgtcattatttgaaagtggactgaagaattgggagatttaggaaatgagaagcagtctgtaaaatgacagtgaacccatttcaaatcttcctgctttctcaaatacagaagcactggctcaggcgatcagggaagccagagagcagcaccctgacatgtcggtcacaagagtggtggtacacaaagaaacagagttggctgaggaaggggaagattaagtaagcaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321891 - DNA, 2741 bp, Homo sapiens
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccacagaaagttaacggagaggtgtcccatgttgacattgatgttttgccacaaattatttgttgttcagaggtaaatgggagtcccaggtgggagccaaactctagagctgcttctcagatggggaactcctgcctttcttctcctgtcctcccagttcttcagcttttttcaacaagaatctgatttttctctctcatgggaggaagggggaagcactgctttgtggattttctgcccgcccagttcatgggttccagcttctctgcggccactggacacctgtagggtaaactttcctagaagcaccacatcaatttttccttcccttttcacatttaaatttttctttgcatgttttgggtgttttcaactgttttgtcttcagttgcactgcttcctcacactaaatgcctttttttccccttttggtttaattagaaaaatgtatatgtaatgttgaaaaaa

SEQ ID NO: 321892 - DNA, 1737 bp, Homo sapiens
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321893 - DNA, 720 bp, Homo sapiens
gctcggtacccggtgtttatcgatgccacagcttttgtttcaggaaagccctgagcagaaacataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321894 - DNA, 1073 bp, Homo sapiens
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcaggtatgtttgggaataattgcctggaaatgaaaacctgatagcgtaaccacataataaaaagggtttgtttgttttggatcatttccagatttcttgtactgagatactgctttagcttaatgtatacggaatgggtcttagattggtctaccatagcctttccctgttactccttgaaaaaaaagtcccctatatataccaattactaaaaaattcatgtctgtaacctgtttaggtgaggtagatactccgagccctgccatctcttttttaaacagaatgctcttttatgcctctttaagttttcactggacagtaagtagtagatttgtgtgtgcgcattttagttgcctaacaaagcctaggttttgccatggtataagattttaattggaaatgttattatttgagatgatacttaaattgtagttgctggga

SEQ ID NO: 321895 - DNA, 372 bp, Homo sapiens
ggcacgttactgaccgcacaaaccatcacatctgagtccgtgtcaacaacgacaaccacacacatcaccaaggtaaagcaatgcaggggatcatatggagaggatggtacattacagacagaatcttttctgaattgtttctctcttcctgtacacacttccaagtaagatacagacagtgccagcggaatcaaaatgccttggtttaaagtatccaagaaattaggctccattgacaaatgcattcaagccaaattgcaattttgtgaagtacaagggggtaaaaatatgttacgaatagctatatgtaagatagctacaaaaccataaataatttaataaaatttataatttataaaaacaaacttgtgc

SEQ ID NO: 321896 - DNA, 4418 bp, Homo sapiens
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321897 - DNA, 4896 bp, Homo sapiens
gcattggaacagtgatggtgaattacgggatttaatattggaacacagaataatacatttttgttattttaccttcttggctgttacacaccatacacttaaaactgttttttctaatacctaacattttgatagattttgggtttaatgtatgaaattgtagtgaaatgtgtctcattgctttctagcactgttgataacatcttcctgttacagaataaagaataccaagtacagataaaagtaatttttcttaaaaaacttggattttagatatcaattattgtttataacaagttgaaaccaaataaaagtaatccctgtttcttgagttcttgatgattttaagttctagctatatggaactcagaacacacagagttctattgtgatgctagttttgggtctgtgatgctgatagagaattctaaaagttcgagcaacagtctccattttgtcttgtgcttttgaatcttctttcttgatgtgctttctccctgtcatctgttactcttcttctcatctttccttaccatgcccctcgcaaccaaactaaatttgagagaacttacaaaatgacattttatgatttttgttttgattacagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321898 - DNA, 5071 bp, Homo sapiens
attgtttttagagatggggtcttgctgtgttgtctgggccggagtacactgggtactcacagatgtgatcattgcatactacagccttgaactcctgggctcaagtgatccttctgtctcagtttcctgagtacctgggactagaggtgtgtgccaccatgctggttatctataagcacttttacatttatttatttatttaattcttgtagtaactctttgtggtaggtactattatcctaagtatcctataagaaaactgaggcactgcagtttgaagtaacttgctcagggtcactcagccaattaatggtggagcagcggtttgaacccaggctgtctagttccagagcctatagccataactactgtcttatattatccctaagaatatgtaaacgacgtcaaaccccgatcctatttgcattcccctccccacgggtaactatcttgaatcagagccaatactacactattgcattagggtataatttaatcattaggggatagttttcatgcagaaactagaaagcactgatgagattctactcatgttcctttaccagctttagttataaaggggaagcgggaaaatggaagcacgtagaggataaggtgataacctccaccttaccatcttccttcttcccccttaaaaaagaaatggaatgttgagtctatctggaatgttgacaggttaaaaaggagctgttgaagcctgtcgttcacagtagcatcgaaaggtgaaaatttgtctccacttgagtaccttgaaatggcagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321899 - DNA, 3959 bp, Homo sapiens
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321900 - DNA, 4619 bp, Homo sapiens
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagcctagaagaggagataacatcaattttgtttagtgaaaagggcttttctgatagcatgaaagccaccttcacttcagccaccacttggacagcagagggcgctgttgtgagcgctaatgcaccttctgaaaagctttcttcctcgcccttctcacacttgcttgagacacgtgctcccgagtcagaagggccttgcactggagccagggatgctgttaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321901 - DNA, 2393 bp, Homo sapiens
tcctaaatagagaagaaatcagaaccctttaaaatgtaaatcattgaagaagtacgcattgactttattttcaaattttgatgaattcatgaacttactcatagataataatatggctttagagacttggcatttttcttgctttactatggttttttttttaatcgtaagtttgctttgtcttattttttggttttatttttgtcctactgggttttttccttttggatttttcccccctttgttacgttacatattgctaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321902 - DNA, 2348 bp, Homo sapiens
tctgtcagaattctcatcttttctttcattttatgctgttctgttgttctttcttgtgtaacctttcctttcttccaataggtcactgctgtctgttctgacttattgctaattctttgctcttccttttctgacctctctagagcctagaagaggagataacatcaattttgtttagtgaaaagggcttttctgatagcatgaaagccaccttcacttcagccaccacttggacagcagagggcgctgttgtgagcgctaatgcaccttctgaaaagctttcttcctcgcccttctcacacttgcttgagacacgtgctcccgagtcagaagggccttgcactggagccagggatgctgttaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321903 - DNA, 4364 bp, Homo sapiens
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagagccgttctctgtcctgaccctggcaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 321904 - DNA, 4520 bp, Homo sapiens
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaagctggcaccagagacccgatagggacttattaactatattgaacattttttcctttgcctttgaccctatgtatagttacgatgccagattagatttatagg

SEQ ID NO: 321905 - DNA, 4433 bp, Homo sapiens
  misc_feature (4215)..(4216): n is a, c, g, or t
  misc_feature (4432)..(4432): n is a, c, g, or t
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccaaatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgtnntgcgattaccaattccacacaggcctaggacgcccggaagtgataaagactctatgcccctgaggtggcccaatatagttaggcttaacttccctctaaattggcgcagggcctccaccgccccgctttttccaaacctgggaaaacctgtttgttgcccaccttcatttcaaggcaaacagaccacactctctggggatggaggagagcgaactna

SEQ ID NO: 321906 - DNA, 2555 bp, Homo sapiens
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagcctagaagaggagataacatcaattttgtttagtgaaaagggcttttctgatagcatgaaagccaccttcacttcagccaccacttggacagcagagggcgctgttgtgagcgctaatgcaccttctgaaaagctttcttcctcgcccttctcacacttgcttgaggtgcattttactttgtttcccctgttactaaaagccacatatgagagagattttcatttttttaaatattcaggcaccattccctccagtgctttcattggtgaaattaattcttcctgggagaaacattcaagaaacaatgactgaattggaacatgaagaaaagatatagattggatgtttctcctgcttctttggtca

SEQ ID NO: 321907 - DNA, 980 bp, Homo sapiens
  misc_feature (932)..(932): n is a, c, g, or t
ccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagcataagctgtgggcatgactactgaagtagactctgtgtctgaagtgaagaaggactctagccagttaggaacagatgcaaccnaggaaaaacctaaagaagttgcgggatgtggcgggtacagagctcgaa

SEQ ID NO: 321908 - DNA, 771 bp, Homo sapiens
aacggctaggtacgaggctggcgcgtatatcggccgaggcttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggctccttgttgctgtgaggaacgtgacgtggacatatgataagcacatgtggaaacaaaaaacaaaaaaaa

SEQ ID NO: 321909 - DNA, 568 bp, Homo sapiens
gccgtggggaccctgagtgtccccgtgtgcctgcgtgcttcccgtctccccacgatgctgctggggttttgaaacagaaacagccagggcaaggggacccatcgtcggagcagtatgaaccgtttcacccgcgtcctgggttcagggcgagccaggcaccccttggaggaatgttcttgaaaagagtgtggtcctttgagtccgtgaggactggctatgctgggtgctgggctccatgttgggccctggagacggagggacagggcaggccaggagtctctgccttcagggagatggctctgggtgcctgctgaggggcagttctgatgtgcagagcctcggaacgaacagcagggaacacggccgctcagaaacaggcaacagtcaggtgaggctgagcagcccaggggtgagcggccctcctgcggggcctcagggccgaacccacttccagtgtgcagagtggacgcaaggccgcctggtgacggaggcgcctgcaggaaactctggaagtgctggagcgaagacgggacctttcacgttcagtgcagcacacggcttaggtcag

SEQ ID NO: 321910 - DNA, 317 bp, Homo sapiens
gtagctgggaccacaggtatgcagcgtgacacctggctaatttttgaattattttgtagagacaggagtctcactgtgttgtccaggctggtctcaaactcctaagctcaatcagtcctcccacctcgccctcccaagatgctgggattacaggcgggagtcgccacgcctggcctaacttgcttttttttctgttatgaatgtagtaacacaagcgggagagggaatttagaaatggaacccaagttggggttccttccaagaaggtggcagctcccattcttggggcatttccgtggcctgtctgggccacagct

SEQ ID NO: 321911 - DNA, 2398 bp, Homo sapiens
ggcccgcgggccggaacagccgcggcaagtggcggcggcggcagcggcagcggaggcagctgaggcggcggcggcgagtgggggtccgggcggcggcggcgggcccggcggcgggccgaggagccgggcgcaatggagcggaagagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321912 - DNA, 2517 bp, Homo sapiens
ggtgctctgggtctggctggcgcccagatctaggggccagttgtggggtgctggggtctgggatgaaggtctggggtcacgccagggttggggtctggggctggggccagggcctgcctgggtttggggtcagggccgtgttggggtctggggctggggtcgcgacctgaagctggggctgggactgggtttgggtctgcggccgaggcctgggtttggggtctggggtccgcccggggcgccgaccgtcccgcctccccgcagccccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321913 - DNA, 2293 bp, Homo sapiens
tggtcaacctatcgcgcatcgagtgaagaggcccccgagaccccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321914 - DNA, 2634 bp, Homo sapiens
  misc_feature (1)..(1): n is a, c, g, or t
naacgatacgtctaggtacgaggctggttatggctggcggagtgggggtccgggcggcggcggcgggcccggcggcgggccgaggagccgggcgcaatggagcggaagaggtgggagtgcccggcgctcccgcagggctgggagagggaagaagtgcccagaaggtcggggctgtcggccggccacagggatgtcttttactatagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcaggtgctgcggggccacgggggctccctggagtcgggtcctggcagtggggactgcctggtgaacacagatgtgcttgggatgacgggtgcctcccaagagcttcccatctccctagaagagcccaagcgtccccgtcccgtggagtcgctaaagccagccctccctgtcctttccagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321915 - DNA, 2444 bp, Homo sapiens
ggcccgcgggccggaacagccgcggcaagtggcggcggcggcagcggcagcggaggcagctgaggcggcggcggcgagtgggggtccgggcggcggcggcgggcccggcggcgggccgaggagccgggcgcaatggagcggaagagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttggaaaaaaaaaacaaaccaagcaacaaaaaaccagcaccaaaaacaaag

SEQ ID NO: 321916 - DNA, 2224 bp, Homo sapiens
ggtgctctgggtctggctggcgcccagatctaggggccagttgtggggtgctggggtctgggatgaaggtctggggtcacgccagggttggggtctggggctggggccagggcctgcctgggtttggggtcagggccgtgttggggtctggggctggggtcgcgacctgaagctggggctgggactgggtttgggtctgcggccgaggcctgggtttggggtctggggtccgcccggggcgccgaccgtcccgcctccccgcagccccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321917 - DNA, 2294 bp, Homo sapiens
ggcccgcgggccggaacagccgcggcaagtggcggcggcggcagcggcagcggaggcagctgaggcggcggcggcgagtgggggtccgggcggcggcggcgggcccggcggcgggccgaggagccgggcgcaatggagcggaagagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321918 - DNA, 1499 bp, Homo sapiens
ggcccgcgggccggaacagccgcggcaagtggcggcggcggcagcggcagcggagcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321919 - DNA, 1374 bp, Homo sapiens
taggctaggtacgaggctggtttgaatcggcagaggctcgtgcttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321920 - DNA, 2962 bp, Homo sapiens
ggcccgcgggccggaacagccgcggcaagtggcggcggcggcagcggcagcggaggcagctgaggcggcggcggcgagtgggggtccgggcggcggcggcgggcccggcggcgggccgaggagccgggcgcaatggagcggaagagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttggaaaaaaaaaaaaaaaaaaaaaaaaaaacaaaaaaaaaaaaaaaaaaaaaaaagggggcgcaaagaaagattctcccacgggggcccacaatatttactgtgtaaccccacgttatttttgtaacaagcaggggcccccatataagggaggccttcgcctaaacatagcagtcgagagacttggcaggcactaatttaaaacacacgacgtgagatggggaaccacggtagcctaggtcgagaggaccatcggagagaggcaccataaccttcgttgcggggtgggaacaatctggcgccacccagcctcaccgcgcgaagatatattaaagctccgacaggaaacaatacacacccatgcggcggcattcatcgtgtagtaacaacacggcgaccatatcgtctgggacagaaaaattggtccccggcgatattattggacaaaatttcgccgcaccgatcaaaaaagacgaacaagcgccgcacagaaccacaaaacgagacgcgcacaccgaacacaaaacgaagccaggctgagagtgcaccaacgacaataacaaacgaac

SEQ ID NO: 321921 - DNA, 1204 bp, Homo sapiens
aaggcttagtacgaggctggtgttgaatcggcaccgaggcagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321922 - DNA, 1530 bp, Homo sapiens
ggcccgcgggccggaacagccgcggcaagtggcggcggcggcagcggcagcggaggcagctgaggcggcggcggcgagtgggggtccgggcggcggcggcgggcccggcggcgggccgaggagccgggcgcaatggagcggaagagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggagccgtgggcgtggggacgtgactgaataaagccaccatgggtggatgtgcttgga

SEQ ID NO: 321923 - DNA, 389 bp, Homo sapiens
cccaagttggggttccttccaagaaggtggcagctcccattcttggggcatttccgtggcctgtctgggccacagctgccccgtggtgacctctccacttgcggctgtttgtccactgcctggcaggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggtagccccttggcctggtcccctgctgctccaccctgtctcttgtggccgtggggaccctgagtgtccccgtgtgcctgcgtgct

SEQ ID NO: 321924 - DNA, 346 bp, Homo sapiens
atggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttggagcctggagttcggtgcgtccgctagactttggtgccca

SEQ ID NO: 321925 - DNA, 2458 bp, Homo sapiens
  misc_feature (1)..(1): n is a, c, g, or t
naacgatacgtctaggtacgaggctggttatggctggcggagtgggggtccgggcggcggcggcgggcccggcggcgggccgaggagccgggcgcaatggagcggaagaggtgggagtgcccggcgctcccgcagggctgggagagggaagaagtgcccagaaggtcggggctgtcggccggccacagggatgtcttttactatagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321926 - DNA, 2418 bp, Homo sapiens
  misc_feature (42)..(42): n is a, c, g, or t
  misc_feature (64)..(64): n is a, c, g, or t
  misc_feature (69)..(69): n is a, c, g, or t
gtgaatatagaaaagtttgtaaaaaaaaaggctggtaaggtncggaattcccgggatgcggcanggcangaaagggcagctgaggcggcggcggcgagtgggggtccgggcggcggcggcgggcccggcggcgggccgaggagccgggcgcaatggagcggaagagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321927 - DNA, 2362 bp, Homo sapiens
  misc_feature (1)..(1): n is a, c, g, or t
naacgatacgtctaggtacgaggctggttatggctggcggagtgggggtccgggcggcggcggcgggcccggcggcgggccgaggagccgggcgcaatggagcggaagagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321928 - DNA, 2645 bp, Homo sapiens
ggtgctctgggtctggctggcgcccagatctaggggccagttgtggggtgctggggtctgggatgaaggtctggggtcacgccagggttggggtctggggctggggccagggcctgcctgggtttggggtcagggccgtgttggggtctggggctggggtcgcgacctgaagctggggctgggactgggtttgggtctgcggccgaggcctgggtttggggtctggggtccgcccggggcgccgaccgtcccgcctccccgcagccccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagagtctcgctctgtcacccaggctggagtgcagtggcaggatcttaactcactacaacctctgcctcctggtttcaactgggttcaagtgatccttccacctcagcctcacaagtagctgggatttcagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321929 - DNA, 2236 bp, Homo sapiens
  misc_feature (13)..(13): n is a, c, g, or t
  misc_feature (16)..(16): n is a, c, g, or t
  misc_feature (19)..(19): n is a, c, g, or t
  misc_feature (28)..(28): n is a, c, g, or t
aggcgtcccaacnagnatnggctaggtnaggccgggtgttaatcggccgaggcccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcaggtgctgcggggccacgggggctccctggagtcgggtcctggcagtggggactgcctggtgaacacagatgtgcttgggatgacgggtgcctcccaagagcttcccatctccctagaagagcccaagcgtccccgtcccgtggagtcgctaaagccagccctccctgtcctttccagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321930 - DNA, 2072 bp, Homo sapiens
  misc_feature (13)..(13): n is a, c, g, or t
  misc_feature (16)..(16): n is a, c, g, or t
  misc_feature (19)..(19): n is a, c, g, or t
  misc_feature (28)..(28): n is a, c, g, or t
aggcgtcccaacnagnatnggctaggtnaggccgggtgttaatcggccgaggggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcaggtgctgcggggccacgggggctccctggagtcgggtcctggcagtggggactgcctggtgaacacagatgtgcttgggatgacgggtgcctcccaagagcttcccatctccctagaagagcccaagcgtccccgtcccgtggagtcgctaaagccagccctccctgtcctttccagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321931 - DNA, 1646 bp, Homo sapiens
aacttaggctagtacgagctcgcgtctaattcggccgagggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321932 - DNA, 2055 bp, Homo sapiens
ggtgctctgggtctggctggcgcccagatctaggggccagttgtggggtgctggggtctgggatgaaggtctggggtcacgccagggttggggtctggggctggggccagggcctgcctgggtttggggtcagggccgtgttggggtctggggctggggtcgcgacctgaagctggggctgggactgggtttgggtctgcggccgaggcctgggtttggggtctggggtccgcccggggcgccgaccgtcccgcctccccgcagccccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcgctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttgga

SEQ ID NO: 321933 - DNA, 1819 bp, Homo sapiens
ggcccgcgggccggaacagccgcggcaagtggcggcggcggcagcggcagcggaggcagctgaggcggcggcggcgagtgggggtccgggcggcggcggcgggcccggcggcgggccgaggagccgggcgcaatggagcggaagagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcgtgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccggcaggggtgttccaatcacgaacgtggtaaacagcacgaccacgggaacgagaagggaaagacctgccagtcgattctacgaggatccccaattcctcagagaacacgagcggaagatgcaacgtagagaaggcagc

SEQ ID NO: 321934 - DNA, 1173 bp, Homo sapiens
ggtgctctgggtctggctggcgcccagatctaggggccagttgtggggtgctggggtctgggatgaaggtctggggtcacgccagggttggggtctggggctggggccagggcctgcctgggtttggggtcagggccgtgttggggtctggggctggggtcgcgacctgaagctggggctgggactgggtttgggtctgcggccgaggcctgggtttggggtctggggtccgcccggggcgccgaccgtcccgcctccccgcagccccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgtagtcagatcgagccgcgtagtcagatcgagccgcgtagtcagatcgatccgcgtagtcagatagagccgcgtagtcagatcgaccgctataagatgggg

SEQ ID NO: 321935 - DNA, 4058 bp, Homo sapiens
  misc_feature (2610)..(2610): n is a, c, g, or t
  misc_feature (2653)..(2653): n is a, c, g, or t
  misc_feature (3653)..(3653): n is a, c, g, or t
  misc_feature (3945)..(3945): n is a, c, g, or t
ttttttttaaatagactatttttctagaacagttttaggttcacagcaaaattgagagtaagatatagagatttcccatatatcccctatccccatacatgcatagcctcctccactatcaacatctcccacgagggtgggaaatttttacaactgatgaacctacattgacaaattatcttaacataaagtccacagtttacattagggttcatgcttagtgttgtacattctatgggtttggacaaacgtatgatgacatgataacatgtatcaacccttacagtatcacacagtgaattttcactgcaaaaatcccttatgctatgcctgtttatctctccctccaccaccaacccctggcaaccactgatctctttattgtctccatagttttaccttttttcatacagtatgtagccttttcagattggtttctttcaattaataatatgcatttaaggttctttcatggcttgatagctcattttgtttttggcatttgtttggatttgccagtttatccattcacccactgaacgacaccttacttgctttaaagttttgacagttgtgcataaagctgctgtaacattcatgtactgtaatgttttaatctttaataatattaattaaatttaacagataaaacttatttcagacctgcccttgttccaggtctgattgaagccagcttgctgaggcaccttcagtaggtcatagctcaactgctgctgtggacttcagggggactcaaaagcattaatcaaaatcttccctctctagagtattttacactttaaaaaaatttataccctattttgtcccccaaaacagataattgacttaaagcaattaaaaaaaagaaaaccaaaaacttcccctttcaactgttcttcagctctctgggattgctcagacctaagctgcctttccattgcatcctgtggtcttttactgatttcattggaaggcaggccttttcctaatggtttactttgacacagcaagcttcctcctaagataaattcctctttttctggttgtatttaaaaatgaagtgtattaaattcttcattctgatagttttcctgagggtatgggactaatattttacgtggtggcatataaataaaacctttttacttttttattggagacaagagtcttgctctgttgcccaggctggagtgcaatggcgtgatcttggctcgctgcagcctctgtctcctgggttcaagaaatccttgtgcctcagcctgccaagcagctgggattatcggtatgcaccaccacacccagctaagttttgtatttttagtagagacagggttttaccatgttggtcaggctggtcttgaactcctggtctcaagtgatctgcctgtttcagcctcccaaaatgctgggattataggcatgagccactacacccgatctttcccaggcatttctcttttgttcatttttggtggttgtatgctagagatttagagggaagaatggtgagatagtgtagaaaattatacttgtgtctaaattaatttgtgcattacattacatatgcatttaacacagaaaataatgtaggaagatgagacagtccaaggaagaaagctaaaaaaaaagttacatctctttatgtaggtaataaacaactatgactattttattcttctagcttttctcctacacatatgctcatgtcaccaccaccaccaattatgacaaatcggaatcattccatattattttatattattgctggctgctaagaacaattaacacactaacattttagttaaatttgcatgtgatatttgaagatcatatatttgataaataacttgtatccagaatacatgtagaactcttataataaaagacttaatagcatcttacaataactcaacaataaagagacaactcagttgaaaagataggcaaaggattttgcagagaagatctacaaaaggccaataagcacaggaaaagaagaataacattactagccgtcaaggacatgcaagtcacaccaacaatgagataaccatttcacatgttctaggatggctatcaaaaagacagacaaggatgtggagaaatcggagccctcatacttgctggtgagaatgtaaaatggtacagctgctgtaagaaaacagcctggcagttccccaaaatattcaacatatagttaccatatgactcagcaaatatactcctaggtatatatacccatgagacatgaaaacacacttctaacacagaaacttgtacacagattatcattcataatgtctagaaagtagaatcaactcaaatgtctatcagctaatgaatggattaacaaatatgcctatacattagaatgttaattattcagcagtaaaaagcaatgaagtacagatacgtgctacaacataggtgaaccttgacgacatgctcagagaaagaagccagtcacaaagtactgcacattgtatgatttcatttatgtgaaatgcccagaataggcaaatccatagggacaggaagtagactaacggttgggggatgggaaggttaggggagtagaactcctaatggctgctacgtttctttgaggantgatgaaaatcacttttgattgtgctgatggttgcacaactcnttggatatactaaaaccattgacctacacacttaaatgggtgaattgtatggtatttaaattctatcttaataaagctctttaacaataatatatatttacaaataaaggctgagaatccctaaatctacattttccggttccagtttttaaaacttcaaacaaaatgttaatgtcagcagcactggattggctgtccagaggttctagccctaggacttttcattagccagttgtgtccctggaagcaagacactcatttgtgaaatgagaataatgtatataatttaatcccataatttttaaggtccttttcctgaattttaatatagggcaaaataatgtaacttttttttttttttgagatggagtctcactttgtcgcccaggctggaatacagtggcacaatcttggctcactgcaacctctacattccaggttcaagctagtctcctgcctcagcctcctgagtagctgggattacaggcacacgccaccacgtccagctaattttttgtatttttagtagagacggggtgtcgccatgttggtcaggctggtctcgaactgctgacctgatgatccgcctgccttggcctcccaaagtgctgggattacaggcgtgagccactgcacctagccccaaaataacgtaacttttaaaaaacttgatatttaagtcttaaaagttgtagacatttcggagatactgttacggtcagaggcttagaaatcattgccaggttactttggctgcttattagaatcaccatgggagcttttaaaacatacctgtgcccgggtcataccgccagagagcctgatttaactggtctccagtggtcttccagcatctcactgctctccttcccttgctctccttatcccttgtcttttgcttacatcatgattttaatgtgcaggcaaagttgagagccactggctttgctaatgagcaatgctgtattggcagcatcaaaagtcagtcattttgtttcantttttattacttgataccatatttatcaacttgtgggttggggatggagagggtatataaaacaacaggtagacatataatagaaaatgtctataaaacatttcacaatttaagttgtgcctgcttataacgatttcttacatcagttttagatataaattactggttatataggttcagctttcagcatgtcttaatttgccactggttttatgaattttcctagacttatcattgtaatagaacataatatttcttattattttataatatctatattactaaagtgttntcatttcatttccataggtcataggttttggatctgttaaaattgcagcattcatagctatggtaggaattctgtctattgtggctcaggtgagtatcattttatctatactt

SEQ ID NO: 321936 - DNA, 679 bp, Homo sapiens
ctccatgttttttagtggcttggtagctcatttctttttagtgatagtctggtatgtaccacagtttgtttgtttatttttttgaattttgttgatattttataatttttcattgcaggactcatttatgtagcatgccactaaaagaggcagaaaatttttcctttaacttaaatttgaatttgtcttgatgtttgtttgctttttgtaggttctacatgaaacattttctcaacacacattcctcatgaatggtctcattcaaggtgtaaaggtaagaaaaaatttttatgtggtttgtaatgaaccaaagtcaggaatccttggtagtttaactctggaagttttagtgggactttgggaaacaaatactatttgttctggaggctgaaatctaaatttttagctgggttattaaaagtcactttaaaatacaacacaaatacataaggcatagaatggtttactggcaaatagcagtgtgaatactctataggcctaacttcatttttacttattttttgttttcaagggctcatggaatcagtcttccatgtgacagctttttaaatattttaagacaaaaactgagtcttctaatcttaattgtgttctagcagtagtcattgtaattatagatatttttataatttatttgtttagtggatatctgccactg

SEQ ID NO: 321937 - DNA, 636 bp, Homo sapiens
agtttgacctgtagcggctggagcgtacttatttgtctaccagatataaaagttgaacatgatcactttgaagaatagagtgaatttacctatacggatacgctctgtactgaatatggctttaaagaagttacattatgaattgagagaagtgattttcttaaaaggttctgtaggaatatatttccaggttctgtttataggaagttcgggatctgttcagggattttaatcagtgtgttaacaaagatgagtaagtgtgttttgtgggtttatttttttgcttttttttttagctatatgatttgaaatatatacctctgaaattaagacttgtaacttcctcagaaagatggtgatagaacttccttttattaaccatttgacttttgttattcatcttaatagatcaaaataatgaagctgatgtcccagaacattggcaacattaatgtgtattggcattttaagtgtgttctttctgcttattctcagtcgttgaagaaagttggaaaagattctactgtcttactaatctgcatcaccgtgtttctttcataccttcctgaagctggacagtattcaagtttttttctctatctcaggcaggtgagtagtgagtggctagtagccttt

SEQ ID NO: 321938 - DNA, 2964 bp, Homo sapiens
aggctggtaccggccggagtgtaaggatcaagggccagtcgcgagctacaaggctttggccgaccaagtgtgtaccatgctgctattgtcatcttccttgaattctttgcgtggggcctgttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtggtattttgcgatgatttctgtgtctggagtcttctcggtcacgttttctgttatatttgcctatgtagctgatgtcactcaggagcacgagcgaagtacagcttatggatgggtctcagccacctttgcggctagtcttgtcagcagcccggccattggagcatatctttctgccagttacggagacagcctcgttgtgctggtggccacagtggtggctcttctggacatctgcttcatcttagtggctgttccagaatctctgcctgagaaaatgagaccggtttcctggggagctcagatttcttggaaacaagcagacccttttgcgtcgttgaagaaagttggaaaagattctactgtcttactaatctgcatcaccgtgtttctttcataccttcctgaagctggacagtattcaagtttttttctctatctcaggcaggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggatgatgtgggcagcagggaccgtggctgccatgtccagcatcacgtttccggcaatcagtgccctcgtctctcggaatgcagagtcagatcagcaaggagttgcccaggggatcataactggaataagaggactatgcaatggcctggggccagcactgtatggcttcatattctacatgttccatgtggaactgactgagttgggcccgaaattgaattctaacaacgttcccctgcagggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgtttttttttttctcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaatttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttactttta

SEQ ID NO: 321939 - DNA, 3021 bp, Homo sapiens
ggagccgccgcggagctggaggagaaggcggcgtcggagcccgatggcgggagccatgccggagaagcgcgcgggcgcgcaggccgcggggatgcacctggtctacaaggctttggccgaccaagtgtgtaccatgctgctattgtcatcttccttgaattctttgcgtggggcctgttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtggtattttgcgatgatttctgtgtctggagtcttctcggtcacgttttctgttatatttgcctatgtagctgatgtcactcaggagcacgagcgaagtacagcttatggatgggtctcagccacctttgcggctagtcttgtcagcagcccggccattggagcatatctttctgccagttacggagacagcctcgttgtgctggtggccacagtggtggctcttctggacatctgcttcatcttagtggctgttccagaatctctgcctgagaaaatgagaccggtttcctggggagctcagatttcttggaaacaagcagacccttttgcgtcgttgaagaaagttggaaaagattctactgtcttactaatctgcatcaccgtgtttctttcataccttcctgaagctggacagtattcaagtttttttctctatctcaggcaggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggatgatgtgggcagcagggaccgtggctgccatgtccagcatcacgtttccggcaatcagtgccctcgtctctcggaatgcagagtcagatcagcaaggagttgcccaggggatcataactggaataagaggactatgcaatggcctggggccagcactgtatggcttcatattctacatgttccatgtggaactgactgagttgggcccgaaattgaattctaacaacgttcccctgcagggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgtttttttttttctcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaatttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttactttta

SEQ ID NO: 321940 - DNA, 2566 bp, Homo sapiens
gcagagtatatatttgttaaaatcaaacttacatcccaattccaactttgtaaacttccagcagaagctctcatattctgtaaatgttcagcaggagtttgctattcacagatatttaagtgattagtatttctccagagactgaggctgtccctctcagtcatggtaactggtgaacagttgtgatatcctttcaggaagtgccagcagagcaccaggtagacaggcttcttagggaggaggctgaaagcattgagccccaggtcaggctgggagcccccaacactccacccctgtagaaggtcatcagtactgtccagactctgaggttgcaggtcaggcagtgtgcccttagaggtctctggtcatcagggaagggtcttcacacacagagcttgtattttaattctgtgtgttgatgtggtttttcagagttgtctcctttactttgcagacggcctttcttagcatcttgatgagatcattaggaaataagaatactgtcctccttggcttgggcttccagatgctccagttagcctggtacggttttggatcacaggcctggatgatgtgggcagcagggaccgtggctgccatgtccagcatcacgtttccggcaatcagtgccctcgtctctcggaatgcagagtcagatcagcaaggagttgcccaggggatcataactggaataagaggactatgcaatggcctggggccagcactgtatggcttcatattctacatgttccatgtggaactgactgagttgggcccgaaattgaattctaacaacgttcccctgcagggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgtttttttttttctcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaatttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttactttta

SEQ ID NO: 321941 - DNA, 2910 bp, Homo sapiens
aggctggtaccggccggagtgtaaggatcaagggccagtcgcgagctacaaggctttggccgaccaagtgtgtaccatgctgctattgtcatcttccttgaattctttgcgtggggcctgttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtggtattttgcgatgatttctgtgtctggagtcttctcggtcacgttttctgttatatttgcctatgtagctgatgtcactcaggagcacgagcgaagtacagcttatggatgggtctcagccacctttgcggctagtcttgtcagcagcccggccattggagcatatctttctgccagttacggagacagcctcgttgtgctggtggccacagtggtggctcttctggacatctgcttcatcttagtggctgttccagaatctctgcctgagaaaatgagaccggtttcctggggagctcagatttcttggaaacaagcagacccttttgcgtcgttgaagaaagttggaaaagattctactgtcttactaatctgcatcaccgtgtttctttcataccttcctgaagctggacagtattcaagtttttttctctatctcaggcaggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggatgatgtgggcagcagggaccgtggctgccatgtccagcatcacgtttccggcaatcagtgccctcgtctctcggaatgcagagtcagatcagcaaggagttgcccaggggatcataactggaataagaggactatgcaatggcctggggccagcactgtatggcttcatattctacatgttccatgtggaactgactgagttgggcccgaaattgaattctaacaacgttcccctgcagggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgtttttttttttctcttacattctttttttttttcctgtttatacattagaacaagataagatttgaaatacttccttgcaaataatgtgcaactcccaaggtgaaactcaaatagaaagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaatttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttactttta

SEQ ID NO: 321942 - DNA, 2917 bp, Homo sapiens
aggctggtaccggccggagtgtaaggatcaagggccagtcgcgagctacaaggctttggccgaccaagtgtgtaccatgctgctattgtcatcttccttgaattctttgcgtggggcctgttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtggtattttgcgatgatttctgtgtctggagtcttctcggtcacgttttctgttatatttgcctatgtagctgatgtcactcaggagcacgagcgaagtacagcttatggatgggtctcagccacctttgcggctagtcttgtcagcagcccggccattggagcatatctttctgccagttacggagacagcctcgttgtgctggtggccacagtggtggctcttctggacatctgcttcatcttagtggctgttccagaatctctgcctgagaaaatgagaccggtttcctggggagctcagatttcttggaaacaagcagacccttttgcgtcgttgaagaaagttggaaaagattctactgtcttactaatctgcatcaccgtgtttctttcataccttcctgaagctggacagtattcaagtttttttctctatctcaggcaggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggatgatgtgggcagcagggaccgtggctgccatgtccagcatcacgtttccggcaatcagtgccctcgtctctcggaatgcagagtcagatcagcaaggagttgcccaggggatcataactggaataagaggactatgcaatggcctggggccagcactgtatggcttcatattctacatgttccatgtggaactgactgagttgggcccgaaattgaattctaacaacgttcccctgcagggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgtttttttttttctcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaaactagggcccacctttaacagagcacccctttgaaagttttataggtatgaaatatatgtagatatttgtaaagggttttaatttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttactttta

SEQ ID NO: 321943 - DNA, 742 bp, Homo sapiens
aggctggtaccggccggagtgtaaggatcaagggccagtcgcgagctacaaggctttggccgaccaagtgtgtaccatgctgctattgtcatcttccttgaattctttgcgtggggcctgttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtgagtgacttggcccttcacctcctgactgcttgttttgagtcacatgtaaattatacttatatttgcagagcacttcttaactattacaaagcagttgtgcttgtgttttcatttgatctctctggtaatactgaaaaccagtttggacagttgtcattatatccattttataaatggggtagtgaagacattctagaattaagtctgagataagttacttaggtgaagaagtagaaataaaagatgcctcttcaggcagctgatgttgccatgatgtcaggtatgggagtttaaccctgagaatgggctaacaatcctgtcttcattactgtgacttttagttgactttgtaaatatattatttttgtcagctcatcccatggagtaaactgcgtgatcctctgacc

SEQ ID NO: 321944 - DNA, 630 bp, Homo sapiens
aggctggtaccggccggagtgtaaggatcaagggccagtcgcgagctacaaggctttggccgaccaagtgtgtaccatgctgctattgtcatcttccttgaattctttgcgtggggcctgttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtggtattttgcgatgatttctgtgtctggagtcttctcggtcacgttttctgttatatttgcctgtcggcatgcgtgctttacattcggctttggctagacgcccagttcctgatacaaccgcttacacgcagtgccgtcctcacggaacagatgacagcgttgcggcggcaggccaatagcgaatgttgcaccttcttctaccagcaccacgtcgttctggcggtagaccaggttctgacgtattgccgggatttggatgtgaatttgagtttcattacccagttgctctaccacc

SEQ ID NO: 321945 - DNA, 397 bp, Homo sapiens
aggctggtaccggccggagtgtaaggatcaagggccagtcgcgagctacaaggctttggccgaccaagtgtgtaccatgctgctattgtcatcttccttgaattctttgcgtggggcctgttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtggtattttgcgagcaggagaggaatgggggagaggacgtgagggaccacccccacccacacag

SEQ ID NO: 321946 - DNA, 3156 bp, Homo sapiens
ggtggtgacagagagacagaaatctacagctgtctagtcaaaaagcttcaacttccacctcaacaaattctttgttgttgttaatagtttttttctaagaatagcagagggttccccctgaccccaggcagtgctaatgaaatgaccaccaaatgataaaatgttcaaacagtgcagtgtttttagaagattaaatcaagcacagtacttgagtagtttgtaagttttatcatcagccctgcaggaattcttttcataccatctcacatccccggtccccagttaaagaagaccaaagagctaatgttttatttgtggggaaggtttttacaatttttgtttgtaataagataatccttttttactcttgtagctctgcagggtatctccagttaatagtttatgaacacattcttaaatcactttaattctctttcattcttaaaatttatatgcaacacatttcttttgtcttacttaaagccagggaagcatggctgcaggtatgcacctgtgggaccctggttgagtgtgctttcctgaaggtgtgcacctgcagcaggcagacctgggtaaggatatgctttccccagaggtgttcacctatgggaccctgggtgagagtgtgctttcccacaggtctcagccacctttgcggctagtcttgtcagcagcccggccattggagcatatctttctgccagttacggagacagcctcgttgtgctggtggccacagtggtggctcttctggacatctgcttcatcttagtggctgttccagaatctctgcctgagaaaatgagaccggtttcctggggagctcagatttcttggaaacaagcagacccttttgcgtcgttgaagaaagttggaaaagattctactgtcttactaatctgcatcaccgtgtttctttcataccttcctgaagctggacagtattcaagtttttttctctatctcaggcaggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggatgatgtgggcagcagggaccgtggctgccatgtccagcatcacgtttccggcaatcagtgccctcgtctctcggaatgcagagtcagatcagcaaggagttgcccaggggatcataactggaataagaggactatgcaatggcctggggccagcactgtatggcttcatattctacatgttccatgtggaactgactgagttgggcccgaaattgaattctaacaacgttcccctgcagggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgtttttttttttctcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaatttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttactttta

SEQ ID NO: 321947 - DNA, 2793 bp, Homo sapiens
agtttgacctgtagcggctggagcgtacttatttgtctaccagatataaaagttgaacatgatcactttgaagaatagagtgaatttacctatacggatacgctctgtactgaatatggctttaaagaagttacattatgaattgagagaagtgattttcttaaaaggttctgtaggaatatatttccaggttctgtttataggaagttcgggatctgttcagggattttaatcagtgtgttaacaaagatgagtaagtgtgttttgtgggtttatttttttgcttttttttttagctatatgatttgaaatatatacctctgaaattaagacttgtaacttcctcagaaagatggtgatagaacttccttttattaaccatttgacttttgttattcatcttaatagatcaaaataatgaagctgatgtcccagaacattggcaacattaatgtgtattggcattttaagtgtgttctttctgcttattctcagtcgttgaagaaagttggaaaagattctactgtcttactaatctgcatcaccgtgtttctttcataccttcctgaagctggacagtattcaagtttttttctctatctcaggcaggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggatgatgtgggcagcagggaccgtggctgccatgtccagcatcacgtttccggcaatcagtgccctcgtctctcggaatgcagagtcagatcagcaaggagttgcccaggggatcataactggaataagaggactatgcaatggcctggggccagcactgtatggcttcatattctacatgttccatgtggaactgactgagttgggcccgaaattgaattctaacaacgttcccctgcagggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgtttttttttttctcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaatttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttactttta

SEQ ID NO: 321948 - DNA, 2866 bp, Homo sapiens
aggctggtaccggccggagtgtaaggatcaagggccagtcgcgagctacaaggctttggccgaccaagtgtgtaccatgctgctattgtcatcttccttgaattctttgcgtggggcctgttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtggtattttgcgatgatttctgtgtctggagtcttctcggtcacgttttctgttatatttgcctatgtagctgatgtcactcaggagcacgagcgaagtacagcttatggatgggtctcagccacctttgcggctagtcttgtcagcagcccggccattggagcatatctttctgccagttacggagacagcctcgttgtgctggtggccacagtggtggctcttctggacatctgcttcatcttagtggctgttccagaatctctgcctgagaaaatgagaccggtttcctggggagctcagatttcttggaaacaagcagacccttttgcgtcgttgaagaaagttggaaaagattctactgtcttactaatctgcatcaccgtgtttctttcataccttcctgaagctggacagtattcaagtttttttctctatctcaggcaggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggagttgcccaggggatcataactggaataagaggactatgcaatggcctggggccagcactgtatggcttcatattctacatgttccatgtggaactgactgagttgggcccgaaattgaattctaacaacgttcccctgcagggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgtttttttttttctcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaatttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttactttta

SEQ ID NO: 321949 - DNA, 6146 bp, Homo sapiens
  misc_feature (2610)..(2610): n is a, c, g, or t
  misc_feature (2653)..(2653): n is a, c, g, or t
  misc_feature (3653)..(3653): n is a, c, g, or t
  misc_feature (3945)..(3945): n is a, c, g, or t
ttttttttaaatagactatttttctagaacagttttaggttcacagcaaaattgagagtaagatatagagatttcccatatatcccctatccccatacatgcatagcctcctccactatcaacatctcccacgagggtgggaaatttttacaactgatgaacctacattgacaaattatcttaacataaagtccacagtttacattagggttcatgcttagtgttgtacattctatgggtttggacaaacgtatgatgacatgataacatgtatcaacccttacagtatcacacagtgaattttcactgcaaaaatcccttatgctatgcctgtttatctctccctccaccaccaacccctggcaaccactgatctctttattgtctccatagttttaccttttttcatacagtatgtagccttttcagattggtttctttcaattaataatatgcatttaaggttctttcatggcttgatagctcattttgtttttggcatttgtttggatttgccagtttatccattcacccactgaacgacaccttacttgctttaaagttttgacagttgtgcataaagctgctgtaacattcatgtactgtaatgttttaatctttaataatattaattaaatttaacagataaaacttatttcagacctgcccttgttccaggtctgattgaagccagcttgctgaggcaccttcagtaggtcatagctcaactgctgctgtggacttcagggggactcaaaagcattaatcaaaatcttccctctctagagtattttacactttaaaaaaatttataccctattttgtcccccaaaacagataattgacttaaagcaattaaaaaaaagaaaaccaaaaacttcccctttcaactgttcttcagctctctgggattgctcagacctaagctgcctttccattgcatcctgtggtcttttactgatttcattggaaggcaggccttttcctaatggtttactttgacacagcaagcttcctcctaagataaattcctctttttctggttgtatttaaaaatgaagtgtattaaattcttcattctgatagttttcctgagggtatgggactaatattttacgtggtggcatataaataaaacctttttacttttttattggagacaagagtcttgctctgttgcccaggctggagtgcaatggcgtgatcttggctcgctgcagcctctgtctcctgggttcaagaaatccttgtgcctcagcctgccaagcagctgggattatcggtatgcaccaccacacccagctaagttttgtatttttagtagagacagggttttaccatgttggtcaggctggtcttgaactcctggtctcaagtgatctgcctgtttcagcctcccaaaatgctgggattataggcatgagccactacacccgatctttcccaggcatttctcttttgttcatttttggtggttgtatgctagagatttagagggaagaatggtgagatagtgtagaaaattatacttgtgtctaaattaatttgtgcattacattacatatgcatttaacacagaaaataatgtaggaagatgagacagtccaaggaagaaagctaaaaaaaaagttacatctctttatgtaggtaataaacaactatgactattttattcttctagcttttctcctacacatatgctcatgtcaccaccaccaccaattatgacaaatcggaatcattccatattattttatattattgctggctgctaagaacaattaacacactaacattttagttaaatttgcatgtgatatttgaagatcatatatttgataaataacttgtatccagaatacatgtagaactcttataataaaagacttaatagcatcttacaataactcaacaataaagagacaactcagttgaaaagataggcaaaggattttgcagagaagatctacaaaaggccaataagcacaggaaaagaagaataacattactagccgtcaaggacatgcaagtcacaccaacaatgagataaccatttcacatgttctaggatggctatcaaaaagacagacaaggatgtggagaaatcggagccctcatacttgctggtgagaatgtaaaatggtacagctgctgtaagaaaacagcctggcagttccccaaaatattcaacatatagttaccatatgactcagcaaatatactcctaggtatatatacccatgagacatgaaaacacacttctaacacagaaacttgtacacagattatcattcataatgtctagaaagtagaatcaactcaaatgtctatcagctaatgaatggattaacaaatatgcctatacattagaatgttaattattcagcagtaaaaagcaatgaagtacagatacgtgctacaacataggtgaaccttgacgacatgctcagagaaagaagccagtcacaaagtactgcacattgtatgatttcatttatgtgaaatgcccagaataggcaaatccatagggacaggaagtagactaacggttgggggatgggaaggttaggggagtagaactcctaatggctgctacgtttctttgaggantgatgaaaatcacttttgattgtgctgatggttgcacaactcnttggatatactaaaaccattgacctacacacttaaatgggtgaattgtatggtatttaaattctatcttaataaagctctttaacaataatatatatttacaaataaaggctgagaatccctaaatctacattttccggttccagtttttaaaacttcaaacaaaatgttaatgtcagcagcactggattggctgtccagaggttctagccctaggacttttcattagccagttgtgtccctggaagcaagacactcatttgtgaaatgagaataatgtatataatttaatcccataatttttaaggtccttttcctgaattttaatatagggcaaaataatgtaacttttttttttttttgagatggagtctcactttgtcgcccaggctggaatacagtggcacaatcttggctcactgcaacctctacattccaggttcaagctagtctcctgcctcagcctcctgagtagctgggattacaggcacacgccaccacgtccagctaattttttgtatttttagtagagacggggtgtcgccatgttggtcaggctggtctcgaactgctgacctgatgatccgcctgccttggcctcccaaagtgctgggattacaggcgtgagccactgcacctagccccaaaataacgtaacttttaaaaaacttgatatttaagtcttaaaagttgtagacatttcggagatactgttacggtcagaggcttagaaatcattgccaggttactttggctgcttattagaatcaccatgggagcttttaaaacatacctgtgcccgggtcataccgccagagagcctgatttaactggtctccagtggtcttccagcatctcactgctctccttcccttgctctccttatcccttgtcttttgcttacatcatgattttaatgtgcaggcaaagttgagagccactggctttgctaatgagcaatgctgtattggcagcatcaaaagtcagtcattttgtttcantttttattacttgataccatatttatcaacttgtgggttggggatggagagggtatataaaacaacaggtagacatataatagaaaatgtctataaaacatttcacaatttaagttgtgcctgcttataacgatttcttacatcagttttagatataaattactggttatataggttcagctttcagcatgtcttaatttgccactggttttatgaattttcctagacttatcattgtaatagaacataatatttcttattattttataatatctatattactaaagtgttntcatttcatttccataggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggatgatgtgggcagcagggaccgtggctgccatgtccagcatcacgtttccggcaatcagtgccctcgtctctcggaatgcagagtcagatcagcaaggagttgcccaggggatcataactggaataagaggactatgcaatggcctggggccagcactgtatggcttcatattctacatgttccatgtggaactgactgagttgggcccgaaattgaattctaacaacgttcccctgcagggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgtttttttttttctcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaatttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattggtttttaggttaagcttcctaatgcataataaatttacagtggttactttta

SEQ ID NO: 321950 - DNA, 3010 bp, Homo sapiens
aggctggtaccggccggagtgtaaggatcaagggccagtcgcgagctacaaggctttggccgaccaagtgtgtaccatgctgctattgtcatcttccttgaattctttgcgtggggcctgttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtggtattttgcgatgatttctgtgtctggagtcttctcggtcacgttttctgttatatttgcctatgtagctgatgtcactcaggagcacgagcgaagtacagcttatggatgggtctcagccacctttgcggctagtcttgtcagcagcccggccattggagcatatctttctgccagttacggagacagcctcgttgtgctggtggccacagtggtggctcttctggacatctgcttcatcttagtggctgttccagaatctctgcctgagaaaatgagaccggtttcctggggagctcagatttcttggaaacaagcagacccttttgcgtcgttgaagaaagttggaaaagattctactgtcttactaatctgcatcaccgtgtttctttcataccttcctgaagctggacagtattcaagtttttttctctatctcaggcaggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggatgatgtgggcagcagggaccgtggctgccatgtccagcatcacgtttccggcaatcagtgccctcgtctctcggaatgcagagtcagatcagcaaggagttgcccaggggatcataactggaataagaggactatgcaatggcctggggccagcactgtatggcttcatattctacatgttccatgtggaactgactgagttgggcccgaaattgaattctaacaacgttcccctgcagggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgtttttttttttctcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattaactagggcccacctttaacagagcacccctttgaaagttttataggtatgaaatatatgtagatatttgtaaagggttttaatttttttttttgatggggtgctgtgtaaatcttgtatttataaatgtaatgaaggtattgacagaaaaaaatatatacaacttttataaaggattgtgtactgactgaatacatttaaaagaaaatatattttgaaacctgttctgctatgaacagagataacatatctttttactatgctattatgcattaggaagcttaacctaaaaaccaatagcatagtaaaaagatatgttatctctgttcatagcagaacaggtttcaaaatatattttctgtcgac

SEQ ID NO: 321951 - DNA, 2724 bp, Homo sapiens
aggctggtaccggccggagtgtaaggatcaagggccagtcgcgagctacaaggctttggccgaccaagtgtgtaccatgctgctattgtcatcttccttgaattctttgcgtggggcctgttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtggtattttgcgatgatttctgtgtctggagtcttctcggtcacgttttctgttatatttgcctatgtagctgatgtcactcaggagcacgagcgaagtacagcttatggatgggtctcagccacctttgcggctagtcttgtcagcagcccggccattggagcatatctttctgccagttacggagacagcctcgttgtgctggtggccacagtggtggctcttctggacatctgcttcatcttagtggctgttccagaatctctgcctgagaaaatgagaccggtttcctggggagctcagatttcttggaaacaagcagacccttttgcgtcgttgaagaaagttggaaaagattctactgtcttactaatctgcatcaccgtgtttctttcataccttcctgaagctggacagtattcaagtttttttctctatctcaggcaggtcataggttttggatctgttaaaattgcagcattcatagctatggtaggaattctgtctattgtggctcagacggcctttcttagcatcttgatgagatcattaggaaataagaatactgtcctccttggcttgggcttccagatgctccagttagcctggtacggttttggatcacaggcctggatgatgtgggcagcagggaccgtggctgccatgtccagcatcacgtttccggcaatcagtgccctcgtctctcggaatgcagagtcagatcagcaaggagttgcccaggggatcataactggaataagaggactatgcaatggcctggggccagcactgtatggcttcatattctacatgttccatgtggaactgactgagttgggcccgaaattgaattctaacaacgttcccctgcagggagctgtcatcccaggcccgccgtttttatttggggcatgtatagtccttatgtcttttctggttgccttattcattcctgaatacagtaaagccagtggagttcaaaaacacagtaacagcagcagcggcagcctgaccaacaccccagaacggggcagtgatgaggacattgagccactactgcaagacagcagcatctgggagctctcttcatttgaggagcctgggaatcagtgcactgagctgtaaactcggcagaaagtgggattctgcatacgccatctctgagagccatggagggagccacacccctggtgacttcatggtgctggatgggagacgctagcggcatccttcagggccaagtttgataaataccaccgccatcattctgctcatcctcctcctgtttttttttttctcttacattctttttttttttcctgtttatacattagaacaagataagatttgaaatacttccttgcaaataatgtgcaactcccaaggtgaaactcaaatagaaaaagtcatctctctggtagaaaggatggctttcctgtaatgactatagagtaagagtggcagcaatctttccatgcccttttcagcagaaggcacagaacagtagcgggactgccatctctggcaagatttcaggtaaagaatctcttcttaatttctaccttcctgtttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggacctggtgtcctggttgggtccaaggtgattttacagaagaaaaaaacaactcaagcattctggtggcaacatagagattgtaggctgcttctaagaaagttattaacaatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactcctgccttaactgctctgagtatgcatttgttttcaattcatctttatttcaatctgtttaacttttgaatcgcatgggaatacgcacattaagttcctttctaaaataaggttttatgaagctgagtttcacgataagtgtcttgctattttttgagatgttttatggacaaagaaaactttacagatttatatgtattttgctgcaccagtaaatggaccattactctgtttataatgtatgaggtttgcgaaaaattttacaatttataaggatggtacgcgatactttaaaaatttttgga

SEQ ID NO: 321952 - DNA, 4380 bp, Homo sapiens
ggacgggatttgtcatgtttctaggccagcccgataatcccttaggatgacggctctgctgggtccagttgctcagcattgattcctctgctccattcctgcccctctctgccccctccctctgtcctatatatcttcacttctctcctttctccccatcctgtgttctgggagagtggcctcaagttggggcttggctgggagaagtgcagagtgaagggatcaggactgaaatgagtttggaggaggataagcaatcaggatctcaggaaacttctagatctttttctagtttcaattctgcccttaatctatcccttccctttcccagggccttctcacagcccaccactgctccctgaagttccctgtctccattctctagcacgtgaaatcgctaaagaacattctccacttcctgaccatggttcccatggagatagtgatcccctcctcttcacccccagggcaggttgtttccatgggaactgtctaccctgctataggagaaggctatgacctcccgcagaccctctgactcctttagtagctgatttcttgtcctcaaccacccgcctcctgtaaggtgctcctatagggggtggaaaaggtgatggtgctggggtgtgagttgtctgggtcaacaagggttgttgtgggagtagaggccctgctcacaggtgcttcctctcctctccctggggtggggccagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgaggcatcgtcatgtcctggggcaggggcggggggttgggtgtggtgagggaggggacatatcctagggttttcaaataaaacaatcagaaaaa

SEQ ID NO: 321953 - DNA, 831 bp, Homo sapiens
gttggttgcctggcatgtagtgaggacaaggatgttattcctcgagctggataggcagcaaagcactagtaagccctgttggtagaactgggaataaagggactgtcccctgtctcccaggagatggggcagtgcctagggttagctctctgaagacgaattacctgagaggctcttgcccctaccctactctcccaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactggtaagcttctcagtgaagactccagtggttcaggatttgggaagggaggtaggctggtgaggagcaagggcagtctgacccagcagctgaggccgcctcctgcatctctctgcagctgtgcagggtgactctgaagatctccatgggaagggaccacagcctccctcccgtatctcccactaatccaatgggtcatcacctctgacttggaggaattaacttctcacgcatccccagactctctctctgtaactccagccagtttccacttttttccatcaaagtgatgatgacttccatagcccattcccctgctcaaggagagtaaccccttagagtgtcctcggtcttccaacttttaagccattgaaaaaatttttctcctcttgggagtgtgtgtgtgcacatgtgcctgtctgtcttaccagagcccacgtgtttcctcagcagcatatcgtatttgggggttt

SEQ ID NO: 321954 - DNA, 537 bp, Homo sapiens
gaatcgagctggtaccatcatttgaagactgtggcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggctgaccacaaggaccagtgaggactaatttgagttttcacctccttctgtttctcttgcaagtcctggtggagtggctga

SEQ ID NO: 321955 - DNA, 4007 bp, Homo sapiens
cctgcagtagcggggttggggtgggagtgagagagtgaggacgctgggctgggggaaacgggaagccgctgcaagtccaccgcctcagctacccagattgggatctgcccaggcccgctttatggactagtgtgggcggcaggctcctttccgtccctgccctgctgtaccccgctccttggagaccccctgtatccctcccgcaaggtggaatccgcaggctggaggctcccaggggaggcaaacgcctggccctgccctgccccacgccgcaccatgaccctcctgctgctgccccttctgctggcctctctgctcgcgtcctgctcctgtaacaaagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgaggcatcgtcatgtcctggggcaggggcggggggttgggtgtggtgagggaggggacatatcctagggttttcaaataaaacaatcagaaaaa

SEQ ID NO: 321956 - DNA, 3765 bp, Homo sapiens
ccagagcaccaaggaggggctttaatggaggtggagatggggggtggggaggagcgtgctgactgcctcagtctcagggatagatgggcaggctccctcctgttctggctctccgtcgggattcctgcttgctcctttctggcatatgggtgtaccgtgtcgaggctgtaccttggtgtacagtataaggctgtatctcgttgtgcccatattgaggctgtttgttggtgtacagtattgaggctgtatcttggtgtacggtatcgaacctgtccctccatgtgccgtatcaaggctgtatcttgatgtaccgtatcgaggctgtacctcggtgtgctgtatcaaggctgtatctcaatgtataatgtcgaggctggctgccgtgtcttcatccctccttctctctggtatatgcagggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgaggcatcgtcatgtcctggggcaggggcggggggttgggtgtggtgagggaggggacatatcctagggttttcaaataaaacaatcagaaaaa

SEQ ID NO: 321957 - DNA, 2606 bp, Homo sapiens
gttggttgcctggcatgtagtgaggacaaggatgttattcctcgagctggataggcagcaaagcactagtaagccctgttggtagaactgggaataaagggactgtcccctgtctcccaggagatggggcagtgcctagggttagctctctgaagacgaattacctgagaggctcttgcccctaccctactctcccaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgaggcatcgtcatgtcctggggcaggggcggggggttgggtgtggtgagggaggggacatatcctagggttttcaaataaaacaatcagaaaaa

SEQ ID NO: 321958 - DNA, 2230 bp, Homo sapiens
cagctgagtgtgctggctgctggggagaggggcgctgcagcagggtgtgggtgtgagtgtgaggagctcctgggccatgcgcttccctacgctctgctctgtctgttgacacatgagtctcaggctgtaggtaatttgcggacggggctggaatgcgatgtgtgtatttttctaggggcttgcttgtgtgactgctggtctctgtgtgtgtttggggcacacatacatggaatagtccctcagcaacgggaccgcccagggaggagctgctgtgtatgcatggtgggcaggggtgtgcacccatgtggggagtagtgacccagctgcccgtaagggccctgggcctggaggtgcgtgtgtggggtctctgcctccacctgctgtccctggggctgcgggctttcctgcttttcttccttgtgcttcttcgagagctgtgtgtgtgtgtgcaggaggcaggcagggctgtgctcatggcggctcgctctgtggccctcacggcccacgtctgtagtgtctatgtcttccttcagggggttgcctggtctgcccagctggtggggagctgggtgatgctgcacatatggctctaccgtgccttgctggagacccccagacgcgttcctttactcccgcagtgtgagcaggcggccaggtggctggtgtgggccagcatgcaggctggcaaaggcctggctcaggtgtggggcgtggcaacctttgtgcagctgtgtgcccacacggtcttcctgagcatgtacctgtgcatgcacatctgctttgccgccatcagctctaaggtccgtgtgagagtgaacgcaccgttctgtgtctcagtgcccttgaaggtccatgcccctctgagcctgggcatcaaagtggggctgcagggccagaagcatgggagagccacgggggaggcaggtatgcctcagggggagatgttggggaagcaggaaccccagacgtcccggagccccaagcccaccaggagaagggaggtgtcacggagtgagctcagtccagtgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgaggcatcgtcatgtcctggggcaggggcggggggttgggtgtggtgagggaggggacatatcctagggttttcaaataaaacaatcagaaaaa

SEQ ID NO: 321959 - DNA, 3350 bp, Homo sapiens
cctgcagtagcggggttggggtgggagtgagagagtgaggacgctgggctgggggaaacgggaagccgctgcaagtccaccgcctcagctacccagattgggatctgcccaggcccgctttatggactagtgtgggcggcaggctcctttccgtccctgccctgctgtaccccgctccttggagaccccctgtatccctcccgcaaggtggaatccgcaggctggaggctcccaggggaggcaaacgcctggccctgccctgccccacgccgcaccatgaccctcctgctgctgccccttctgctggcctctctgctcgcgtcctgctcctgtaacaaagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacaccttctgcagggctccctcagctggaccatcgtccctgcttctctcccatgttcctgcgtgcagctcacggccttgtgtgtatgtgtgtgtgtgtgtgtgtgaggcatcgtcatgtcctggggcaggggcggggggttgggtgtggtgagggaggggacatatcctagggttttcaaataaaacaatcagaaaaa

SEQ ID NO: 321960 - DNA, 1458 bp, Homo sapiens
cctgcagtagcggggttggggtgggagtgagagagtgaggacgctgggctgggggaaacgggaagccgctgcaagtccaccgcctcagctacccagattgggatctgcccaggcccgctttatggactagtgtgggcggcaggctcctttccgtccctgccctgctgtaccccgctccttggagaccccctgtatccctcccgcaaggtggaatccgcaggctggaggctcccaggggaggcaaacgcctggccctgccctgccccacgccgcaccatgaccctcctgctgctgccccttctgctggcctctctgctcgcgtcctgctcctgtaacaaagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctgtatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgaggcatcgtcatgtcctggggcaggggcggggggttgggtgtggtgagggaggggacatatcctagggttttcaaataaaacaatcagaaaaa

SEQ ID NO: 321961 - DNA, 1806 bp, Homo sapiens
cagctgagtgtgctggctgctggggagaggggcgctgcagcagggtgtgggtgtgagtgtgaggagctcctgggccatgcgcttccctacgctctgctctgtctgttgacacatgagtctcaggctgtaggtaatttgcggacggggctggaatgcgatgtgtgtatttttctaggggcttgcttgtgtgactgctggtctctgtgtgtgtttggggcacacatacatggaatagtccctcagcaacgggaccgcccagggaggagctgctgtgtatgcatggtgggcaggggtgtgcacccatgtggggagtagtgacccagctgcccgtaagggccctgggcctggaggtgcgtgtgtggggtctctgcctccacctgctgtccctggggctgcgggctttcctgcttttcttccttgtgcttcttcgagagctgtgtgtgtgtgtgcaggaggcaggcagggctgtgctcatggcggctcgctctgtggccctcacggcccacgtctgtagtgtctatgtcttccttcagggggttgcctggtctgcccagctggtggggagctgggtgatgctgcacatatggctctaccgtgccttgctggagacccccagacgcgttcctttactcccgcagtgtgagcaggcggccaggtggctggtgtgggccagcatgcaggctggcaaaggcctggctcaggtgtggggcgtggcaacctttgtgcagctgtgtgcccacacggtcttcctgagcatgtacctgtgcatgcacatctgctttgccgccatcagctctaaggtccgtgtgagagtgaacgcaccgttctgtgtctcagtgcccttgaaggtccatgcccctctgagcctgggcatcaaagtggggctgcagggccagaagcatgggagagccacgggggaggcaggtatgcctcagggggagatgttggggaagcaggaaccccagacgtcccggagccccaagcccaccaggagaagggaggtgtcacggagtgagctcagtccagtgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacaccttctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgaggcatcgtcatgtcctggggcaggggcggggggttgggtgtggtgagggaggggacatatcctagggttttcaaataaaacaatcagaaaaa

SEQ ID NO: 321962 - DNA, 1040 bp, Homo sapiens
cctgcagtagcggggttggggtgggagtgagagagtgaggacgctgggctgggggaaacgggaagccgctgcaagtccaccgcctcagctacccagattgggatctgcccaggcccgctttatggactagtgtgggcggcaggctcctttccgtccctgccctgctgtaccccgctccttggagaccccctgtatccctcccgcaaggtggaatccgcaggctggaggctcccaggggaggcaaacgcctggccctgccctgccccacgccgcaccatgaccctcctgctgctgccccttctgctggcctctctgctcgcgtcctgctcctgtaacaaagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggtgagagctcagcgctgtgccc

SEQ ID NO: 321963 - DNA, 367 bp, Homo sapiens
aagaggaaaccatcgtatgtaacactgtccagaatggtgagcctcccctccaggcactagccagagggggaaactggcttcttgtcccgcctctgtcactgcccagtgtgtgactgtgaacaggtcacttcccctctcttcatttgtgaggtgcaagtgccaggtgtgatatgccttgattctgtgctttatccccaacatgacatgttggatcgtactgctgtcagagtgcaatgggattccttgctgctactcttgttttcagttgcccagtcaacttctctgtgtcccaccatgtggtaggctgtccccaccccccatctccacctccattaaagcccctccattgcaatgggaaagcctgggt

SEQ ID NO: 321964 - DNA, 393 bp, Homo sapiens
gtcattctgaggtacacagattgggtttgagtcctgccaagggaatttgctggctatgaaatcttggttaatatgtgtaaacctcagggttaaaacaaccctgttatatagggataaaaagaattctatatcccagagtcgttaggattaaatgatgtaatagaccgttgtagactgaaaagcactccctctgtatatgttaattctcactattatcagccctgattatggagggataaataaaaatggataaaatatttaaaatcctctcttgagccaacagttgcagcctcttcattatttattctccaggctgaccacaaggaccagtgaggactaatttgagttttcacctccttctgtttctcttgcaagtcctggtggagtggctga

SEQ ID NO: 321965 - DNA, 476 bp, Homo sapiens
cctggggaagcggggttctgtagggtcaagactgtggagcacacacggtgaggactcctgaggaggggcaggcctgggtggaggctgttcgcagagctgcagtgagccggagggagagaggttcaggcagggaagggggtacacaggggttaaggggaccgagggaagtgtggtccctgaaagagaggctgggatgtgtgcaggccattgatcccttctcctctctgttcctgccctccagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagacc

SEQ ID NO: 321966 - DNA, 4137 bp, Homo sapiens
tgaagggcctcgacccagctctgcttgccccggtgcatgactagggaggggccgcatgtgcgggaggcagcactgcccacacgtactgtgcagacatgtcagatgacttgtgacctttgtacacatgccatttcccttcttatggctggttttaatttggcttttactctgcatcttccttgcttatccccccggatctgactgttgtgaaggaaggccctgctggattttatgccttacccctcctcttggcaccctgacccatagcattttgcacagaagtcatcaaaatcagctcctgagcacccctgggccttgttcctcatcccctacatcagtcctcctttctttgggccctccctctggtgttgtcctctccctggcatgactttgatgcagcttggtgccctgtggggtggggaggagcgtgctgactgcctcagtctcagggatagatgggcaggctccctcctgttctggctctccgtcgggattcctgcttgctcctttctggcatatgggtgtaccgtgtcgaggctgtaccttggtgtacagtataaggctgtatctcgttgtgcccatattgaggctgtttgttggtgtacagtattgaggctgtatcttggtgtacggtatcgaacctgtccctccatgtgccgtatcaaggctgtatcttgatgtaccgtatcgaggctgtacctcggtgtgctgtatcaaggctgtatctcaatgtataatgtcgaggctggctgccgtgtcttcatccctccttctctctggtatatgcagggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgaggcatcgtcatgtcctggggcaggggcggggggttgggtgtggtgagggaggggacatatcctagggttttcaaataaaacaatcagaaaaa

SEQ ID NO: 321967 - DNA, 4064 bp, Homo sapiens
cctgcagtagcggggttggggtgggagtgagagagtgaggacgctgggctgggggaaacgggaagccgctgcaagtccaccgcctcagctacccagattgggatctgcccaggcccgctttatggactagtgtgggcggcaggctcctttccgtccctgccctgctgtaccccgctccttggagaccccctgtatccctcccgcaaggtggaatccgcaggctggaggctcccaggggaggcaaacgcctggccctgccctgccccacgccgcaccatgaccctcctgctgctgccccttctgctggcctctctgctcgcgtcctgctcctgtaacaaagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgaggcatcgtcatgtcctggggcaggggcggggggttgggtgtggtgaccatattctaaaaaaagtttttggtcaaaaacatcatttagcttaaaactcgggtatagaaatcttcctcatctaaaataaaaactgtcatactaccttcttt

SEQ ID NO: 321968 - DNA, 2789 bp, Homo sapiens
cagctgagtgtgctggctgctggggagaggggcgctgcagcagggtgtgggtgtgagtgtgaggagctcctgggccatgcgcttccctacgctctgctctgtctgttgacacatgagtctcaggctgtaggtaatttgcggacggggctggaatgcgatgtgtgtatttttctaggggcttgcttgtgtgactgctggtctctgtgtgtgtttggggcacacatacatggaatagtccctcagcaacgggaccgcccagggaggagctgctgtgtatgcatggtgggcaggggtgtgcacccatgtggggagtagtgacccagctgcccgtaagggccctgggcctggaggtgcgtgtgtggggtctctgcctccacctgctgtccctggggctgcgggctttcctgcttttcttccttgtgcttcttcgagagctgtgtgtgtgtgtgcaggaggcaggcagggctgtgctcatggcggctcgctctgtggccctcacggcccacgtctgtagtgtctatgtcttccttcagggggttgcctggtctgcccagctggtggggagctgggtgatgctgcacatatggctctaccgtgccttgctggagacccccagacgcgttcctttactcccgcagtgtgagcaggcggccaggtggctggtgtgggccagcatgcaggctggcaaaggcctggctcaggtgtggggcgtggcaacctttgtgcagctgtgtgcccacacggtcttcctgagcatgtacctgtgcatgcacatctgctttgccgccatcagctctaaggtccgtgtgagagtgaacgcaccgttctgtgtctcagtgcccttgaaggtccatgcccctctgagcctgggcatcaaagtggggctgcagggccagaagcatgggagagccacgggggaggcaggtatgcctcagggggagatgttggggaagcaggaaccccagacgtcccggagccccaagcccaccaggagaagggaggtgtcacggagtgagctcagtccaggtgggtaagggaaggggctgctctgtgccccttggacttgtccccagcctcaggtgctagtgccctcttcctgcagccagcccaggcctggagcctgcatctcctcctgctcagccaagcccgtgtgggggcccctcctctccctcactgggcactggcacctctttcctaggctgagtggtctctggggaaggcacaggtggaatgacaggggcagattccagtccttgccctctgtcctctgcgaatagggctgttcatgacagtgttgggcagggagtctttttcctcctctgcccttgcctctctgtacacctgcctccctctgtgtttgttcctttgccttgcagcagctcccttcctcccctttcgtctcctgcccttcctggtgggctgtttctcttctggcttctccaggtgttcctctcttctcggccaccgtgtgttctgccctgggagtccttcagcccgggctgcctcttttcctacccagccccctgtccaagtgcccccaggtgtgcctagtcacgctctgctcacccccgcgctctctctgcagtgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgaggcatcgtcatgtcctggggcaggggcggggggttgggtgtggtgagggaggggacatatcctagggttttcaaataaaacaatcagaaaaa

SEQ ID NO: 321969 - DNA, 1892 bp, Homo sapiens
cctgcagtagcggggttggggtgggagtgagagagtgaggacgctgggctgggggaaacgggaagccgctgcaagtccaccgcctcagctacccagattgggatctgcccaggcccgctttatggactagtgtgggcggcaggctcctttccgtccctgccctgctgtaccccgctccttggagaccccctgtatccctcccgcaaggtggaatccgcaggctggaggctcccaggggaggcaaacgcctggccctgccctgccccacgccgcaccatgaccctcctgctgctgccccttctgctggcctctctgctcgcgtcctgctcctgtaacaaagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgaggcatcgtcatgtcctggggcaggggcggggggttgggtgtggtgagggaggggacatatcctagggttttcaaataaaacaatcagaaaaa

SEQ ID NO: 321970 - DNA, 2232 bp, Homo sapiens
cctgcagtagcggggttggggtgggagtgagagagtgaggacgctgggctgggggaaacgggaagccgctgcaagtccaccgcctcagctacccagattgggatctgcccaggcccgctttatggactagtgtgggcggcaggctcctttccgtccctgccctgctgtaccccgctccttggagaccccctgtatccctcccgcaaggtggaatccgcaggctggaggctcccaggggaggcaaacgcctggccctgccctgccccacgccgcaccatgaccctcctgctgctgccccttctgctggcctctctgctcgcgtcctgctcctgtaacaaagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactggtaagcttctcagtgaagactccagtggttcaggatttgggaagggaggtaggctggtgaggagcaagggcagtctgacccagcagctgaggccgcctcctgcatctctctgcagctgtgcagggtgactctgaagatctccatgggaagggaccacagcctccctcccgtatctcccactaatccaatgggtcatcacctctgacttggaggaattaacttctcacgcatccccagactctctctctgtaactccagccagtttccacttttttccatcaaagtgatgatgacttccatagcccattcccctgctcaaggagagtaaccccttagagtgtcctcggtcttccaacttttaagccattgaaaaaatttttctcctcttgggagtgtgtgtgtgcacatgtgcctgtctgtcttaccagagcccacgtgtttcctcagcagcatatcgtatttgggggttt

SEQ ID NO: 321971 - DNA, 441 bp, Homo sapiens
tgggggttgggatgcagaggcatgaccccctttcttcccctgccccttcctgacatgagatgctctatgatagaggtagctggggcggggagtgaaacagaatgtgggttttcggggaggaagtgttggggtcacatgctgcttctcctgctttcttacataggtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacaggtaaggacgacttcggggagtaacaccatccagagaaccagccagtgtctg

SEQ ID NO: 321972 - DNA, 358 bp, Homo sapiens
ctatacaatattttgaggtgagaactctgtctgtggaatgcttaagaaagaatatataactttgcgtaaagaaagtagccgagtagagagcaaatagtgtatctagttgaaatgttagttctttgaattagcaatgtttagacaataatgtgtgagaaaatatctgtatatgatagtgtgccttgtaggaaagatacttggagttttctgctgtgcaccataagtcttgtctgtgcgtacaatgaattccagttgtgataagtagatctatgctcaagttcacaggtgggctggaatcactgtagactgcccatgtcagacagtcaggaatgtgactgtatgtaccattttccccctg

SEQ ID NO: 321973 - DNA, 212 bp, Homo sapiens
aaaaataagtgaaataagatagaaggaagggggtctggctttattgtggagggcactgttttagggaggtacatacatgaatatgttcctccgtcagggaactgagggtccactgcactgattctcaaccatggctgcacattgaaatcactgatacccactccgaccctataggttctgagttcagtggcctggagtgtggtgtgaccggc

SEQ ID NO: 321974 - DNA, 94 bp, Homo sapiens
caggtgttatcattctttggtcctccagaacaggcaacatgccttgggcattccccaaacctgctgtcatgacctttactcctgcttgaccagc

SEQ ID NO: 321975 - DNA, 1089 bp, Homo sapiens
actcactaggctcttaatagtagctcctcttataagcagaacagggcaaagtagtaattgcaactgagaagagaaaatgcagttcaaagcaagattaaaaggatgagtaaagtcccctagagagctcagccctacaggatttgagattctcattcattcacaccttccctccttccttcccttctaatttttgttcaactacttccctcttttcctctctctctacccaccaaccattatgctagactccacatgcagcatctcattttatccacctggagcttgcttttgccctactctcctcagtggagaattctcttcctcctgtccctcccttcacccccgcttcctgtctctgagcttccttctccaggtttgctcctttccatcaggtatcactttatcaccacctcctcaaagaggccgtgttcatgtccaggcccacaatctcaagtagccatcctgtgattctgtatcatattatcctttttaaactctatgcagcatttactacctctgatgttttttcttctttaaggatttgattgccttatgtgacaagcccaagatctgtgacagttggagctcaaactaggcagtcttgattccagactgctctgaactagtatttgaaggaactaatgaacatgacatgttaaatgaaagtttggggacgtacactcaggatggaagcagggggacacaacagaaatgaaagaattttctgtagatctgggatctggacacctgccccccgtcatgggaaggcagtaaacaagatgctaactgatggagtgaaatccccaggagatgcagaaggcaagtgcagctaactgaggcctcaggggcaggagatgcccatcaggatgagagctatgtctttctccagtgatgactctgcttctatgaggtcaccagcagtagaaccatatcttgctggcatacacttgggatggccccgcctcctggacttccatctgtcatcaggagaacataaccatctggagtcagtacagatcatcaatccttccacatatacaagttcattttaaatttttaaaaatataatacaactgagaagtcttcatt

SEQ ID NO: 321976 - DNA, 2219 bp, Homo sapiens
tacatgtacatatcaaagagagactggagaaaaatttcttattgtccatcccatacattatttgtcaattgtactgttcccacacccttcctagcaacagtatgtaggagaggggttctcagagaccgacagtgaacttgtcctgtgcaattaaatcggtattcctgaacttcacagttgaaagtctagattacctaggtaggggctgtttctctaaggttttggtcccccaaacaatagaaaagctacaagaaatatgcatttttctagatttgcctatgtagacactgtgaccagcctagcccaaactgtattatttagtagatcatctagttggccatacagcctctatagggaattataccctgaggcattttttatttatatttaaaatgtactttatatgaagtaaattatactctaatgaagtagaattataaccaacaaaagaaacagtataaaatggtgcccatatctgaagtattatttgtttctagataattatatgacattatctcgtttgattgatctcctaagaagatgtggaaaactcgaggatgtcccaagatttttctcaatggctgagaaacgtaactccagagcaaaattggaaccaggatttcagtattgtaaaggactgtatctttggtacactggagaaccaaatgatgcccttcgacattttaataaagctcggaaagatcgtgactggggccaaaatgccctttataatatgatagagatctgtttgaatccagataatgaaactgttggaggtgaagtatttgaaaacctggatggagacctgggtaattcaactgagaagcaagaatctgtgcaactggcagtaagaacagcagaaaaacttcttaaggaactaaaacctcagactgttcagggtcacgtacagcttcgcataatggaaaactattgcttaatggctaccaaacagaaatctaatgttgaacaagcattaaataccttcactgaaatagcagcatctgagaaggagcatatcccagcgctcttgggaatggcaacggcttatatgatcttgaaacagactccacgagccagaaaccagctgaagcgtattgcgaaaatgaattggaatgctattgatgctgaagagtttgagaagagttggctgctacttgctgatatttacattcaatcagcaaaatatgacatggcagaagacctgttaaaacggtgcctgcgtcataatagatcttgctgcaaagcttatgaatatatgggatacattatggaaaaagagcaagcatatacagatgctgccttgaactatgagatggcatggaaatatagcaatcggacaaatccggcagtaggatacaaactggcatttaattacttaaaagcaaaaagatatgtggattcaattgacatatgtcaccaggttcttgaagcacatccaacttatccaaaaatcagaaaggatatacttgataaggcccgtgcgtctttaagaccttgaaaataattttaacttaggtgttggtttaacaggaaatgaaagaaatctaactttcagttcttcctgttcaaaacaggatttgattgccttatgtgacaagcccaagatctgtgacagttggagctcaaactaggcagtcttgattccagactgctctgaactagtatttgaaggaactaatgaacatgacatgttaaatgaaagtttggggacgtacactcaggatggaagcagggggacacaacagaaatgaaagaattttctgtagatctgggatctggacacctgccccccgtcatgaataaatgccatcccttcccacgccaaccatatcgatgatatagtggcaggaaggagagtaagggactctggagcttaaacagaccatcacatgggaaggcagtaaacaagatgctaactgatggagtgaaatccccaggagatgcagaaggcaagtgcagctaactgaggcctcaggggcaggagatgcccatcaggatgagagctatgtctttctccagtgatgactctgcttctatgaggtcaccagcagtagaaccatatcttgctggcatacacttgggatggccccgcctcctggacttccatctgtcatcaggagaacataaccatctggagtcagtacagatcatcaatccttccacatatacaagttcattttaaatttttaaaaatataatacaactgagaagtcttcatt

SEQ ID NO: 321977 - DNA, 2922 bp, Homo sapiens
ggaatgaaaagaattggagcttccacaaaatcaaaagacagaaaaactgaagttgatacaagccatcgtttatcgatctttcttgaattgatagacgttcaccgcttaaatggagagcagcatgaggcaaccaaagttttacaagatgccatccatgaattttctggaacatctgaagaagtgcgggttaccatgtgctaatgcagaccttgctctagcccaaggagatattgaacgggctttaagcatccttcagaatgttacagccgaacagccttattttatagaggccagagaaaaaatggcagatatttatctgaagcacagaaaagataaaatgttatatatcacttgttttagagaaattgctgaaagaatggctaaccctcggtcttttcttctccttggtgatgcatacatgaatattctagagcctgaagaagccatagtagcatatgagcaagcattaaatcagaacccgaaagatggaacattggcaagcaaaatgggcaaagcacttatcaaaactcataactactcaatggcaatcacttactatgaagctgctctgaaaactggacaaaagaattatctttgctatgacctggctgagctcttattaaaattgaaatggtatgacaaagcagaaaaagttcttcagcatgctctggctcatgaacctgtaaatgaactgtcagctctcatggaggatggacgttgtcaagttcttctagcaaaagtttatagtaaaatggaaaaacttggtgatgcgatcactgcattacaacaggctcgagaattacaagctcgggtactaaaacgtgttcagatggaacagccagatgcagttcctgcacagaaacatttagcagctgaaatttgtgcagagattgcaaaacattctgttgctcagcgagactatgaaaaagcaattaagttttatagagaggctctggttcactgcgaaacagataataagattatgttggaactggcacgattatacctggcacaagatgaccctgattcctgcctgcggcagtgtgctctactgcttcagagtgaccaggataacgaagctgctaccatgatgatggctgatctcatgttcagaaaacaagactatgaacaagcagtgtttcatttacagcagcttttagaacgtaagccagataattatatgacattatctcgtttgattgatctcctaagaagatgtggaaaactcgaggatgtcccaagatttttctcaatggctgagaaacgtaactccagagcaaaattggaaccaggatttcagtattgtaaaggactgtatctttggtacactggagaaccaaatgatgcccttcgacattttaataaagctcggaaagatcgtgactggggccaaaatgccctttataatatgatagagatctgtttgaatccagataatgaaactgttggaggtgaagtatttgaaaacctggatggagacctgggtaattcaactgagaagcaagaatctgtgcaactggcagtaagaacagcagaaaaacttcttaaggaactaaaacctcagactgttcagggtcacgtacagcttcgcataatggaaaactattgcttaatggctaccaaacagaaatctaatgttgaacaagcattaaataccttcactgaaatagcagcatctgagaaggagcatatcccagcgctcttgggaatggcaacggcttatatgatcttgaaacagactccacgagccagaaaccagctgaagcgtattgcgaaaatgaattggaatgctattgatgctgaagagtttgagaagagttggctgctacttgctgatatttacattcaatcagcaaaatatgacatggcagaagacctgttaaaacggtgcctgcgtcataatagatcttgctgcaaagcttatgaatatatgggatacattatggaaaaagagcaagcatatacagatgctgccttgaactatgagatggcatggaaatatagcaatcggacaaatccggcagtaggatacaaactggcatttaattacttaaaagcaaaaagatatgtggattcaattgacatatgtcaccaggttcttgaagcacatccaacttatccaaaaatcagaaaggatatacttgataaggcccgtgcgtctttaagaccttgaaaataattttaacttaggtgttggtttaacaggaaatgaaagaaatctaactttcagttcttcctgttcaaaacaggatttgattgccttatgtgacaagcccaagatctgtgacagttggagctcaaactaggcagtcttgattccagactgctctgaactagtatttgaaggaactaatgaacatgacatgttaaatgaaagtttggggacgtacactcaggatggaagcagggggacacaacagaaatgaaagaattttctgtagatctgggatctggacacctgccccccgtcatgcaccctcagtcatcacagtcattagactggacatctgcctccatggagaatatgtgaatacctgtgaatgtacttcctggaggcgctgccaaactatttccagcaatgacaaaacatagcatggaaggcagtaaacaagatgctaactgatggagtgaaatccccaggagatgcagaaggcaagtgcagctaactgaggcctcaggggcaggagatgcccatcaggatgagagctatgtctttctccagtgatgactctgcttctatgaggtcaccagcagtagaaccatatcttgctggcatacacttgggatggccccgcctcctggacttccatctgtcatcaggagaacataaccatctggagtcagtacagatcatcaatccttccacatatacaagttcattttaaatttttaaaaatataatacaactgagaagtcttcatt

SEQ ID NO: 321978 - DNA, 2800 bp, Homo sapiens
ggaatgaaaagaattggagcttccacaaaatcaaaagacagaaaaactgaagttgatacaagccatcgtttatcgatctttcttgaattgatagacgttcaccgcttaaatggagagcagcatgaggcaaccaaagttttacaagatgccatccatgaattttctggaacatctgaagaagtgcgggttaccatgtgctaatgcagaccttgctctagcccaaggagatattgaacgggctttaagcatccttcagaatgttacagccgaacagccttattttatagaggccagagaaaaaatggcagatatttatctgaagcacagaaaagataaaatgttatatatcacttgttttagagaaattgctgaaagaatggctaaccctcggtcttttcttctccttggtgatgcatacatgaatattctagagcctgaagaagccatagtagcatatgagcaagcattaaatcagaacccgaaagatggaacattggcaagcaaaatgggcaaagcacttatcaaaactcataactactcaatggcaatcacttactatgaagctgctctgaaaactggacaaaagaattatctttgctatgacctggctgagctcttattaaaattgaaatggtatgacaaagcagaaaaagttcttcagcatgctctggctcatgaacctgtaaatgaactgtcagctctcatggaggatggacgttgtcaagttcttctagcaaaagtttatagtaaaatggaaaaacttggtgatgcgatcactgcattacaacaggctcgagaattacaagctcgggtactaaaacgtgttcagatggaacagccagatgcagttcctgcacagaaacatttagcagctgaaatttgtgcagagattgcaaaacattctgttgctcagcgagactatgaaaaagcaattaagttttatagagaggctctggttcactgcgaaacagataataagattatgttggaactggcacgattatacctggcacaagatgaccctgattcctgcctgcggcagtgtgctctactgcttcagagtgaccaggataacgaagctgctaccatgatgatggctgatctcatgttcagaaaacaagactatgaacaagcagtgtttcatttacagcagcttttagaacgtaagccagataattatatgacattatctcgtttgattgatctcctaagaagatgtggaaaactcgaggatgtcccaagatttttctcaatggctgagaaacgtaactccagagcaaaattggaaccaggatttcagtattgtaaaggactgtatctttggtacactggagaaccaaatgatgcccttcgacattttaataaagctcggaaagatcgtgactggggccaaaatgccctttataatatgatagagatctgtttgaatccagataatgaaactgttggaggtgaagtatttgaaaacctggatggagacctgggtaattcaactgagaagcaagaatctgtgcaactggcagtaagaacagcagaaaaacttcttaaggaactaaaacctcagactgttcagggtcacgtacagcttcgcataatggaaaactattgcttaatggctaccaaacagaaatctaatgttgaacaagcattaaataccttcactgaaatagcagcatctgagaaggagcatatcccagcgctcttgggaatggcaacggcttatatgatcttgaaacagactccacgagccagaaaccagctgaagcgtattgcgaaaatgaattggaatgctattgatgctgaagagtttgagaagagttggctgctacttgctgatatttacattcaatcagcaaaatatgacatggcagaagacctgttaaaacggtgcctgcgtcataatagatcttgctgcaaagcttatgaatatatgggatacattatggaaaaagagcaagcatatacagatgctgccttgaactatgagatggcatggaaatatagcaatcggacaaatccggcagtaggatacaaactggcatttaattacttaaaagcaaaaagatatgtggattcaattgacatatgtcaccaggttcttgaagcacatccaacttatccaaaaatcagaaaggatatacttgataaggcccgtgcgtctttaagaccttgaaaataattttaacttaggtgttggtttaacaggaaatgaaagaaatctaactttcagttcttcctgttcaaaacaggatttgattgccttatgtgacaagcccaagatctgtgacagttggagctcaaactaggcagtcttgattccagactgctctgaactagtatttgaaggaactaatgaacatgacatgttaaatgaaagtttggggacgtacactcaggatggaagcagggggacacaacagaaatgaaagaattttctgtagatctgggatctggacacctgccccccgtcatgggaaggcagtaaacaagatgctaactgatggagtgaaatccccaggagatgcagaaggcaagtgcagctaactgaggcctcaggggcaggagatgcccatcaggatgagagctatgtctttctccagtgatgactctgcttctatgaggtcaccagcagtagaaccatatcttgctggcatacacttgggatggccccgcctcctggacttccatctgtcatcaggagaacataaccatctggagtcagtacagatcatcaatccttccacatatacaagttcattttaaatttttaaaaatataatacaactgagaagtcttcatt

SEQ ID NO: 321979 - DNA, 1535 bp, Homo sapiens
cttaatccatgcagtttcctctgtctgagagtgtccttgattcccaccctagcctagtttatgcctcattcttcagatttcagacatctcttgatacccttcaggttctttatggtaactcacttggcctggatctttctttcataacatttatctcagttttgaaattatttactcatgcaattattttaaaatgtactttttctcctaatagaatgcaaacctcataactgtaggcatcagtttgcctgtgtaagtgctaaataaatctgtactgtataaatgaatggctgtgttgtcatttactgccctatgatgagtttttactataacctgaaataaatgagacttttctagtaagttatagaaaccacacttgtgggatggcagctttctaacctatcaatgtattcactgtggtccttttttccaactccactttcttttcttcttacacttcttttgtgtcactctgtcttctattatcacacaacttctctgtatagcgtagtttggttgttcattcaccagcctcccttaccattctctagtgagtaagcaaagagaggaggaggcaaggaaaagtaatagtagcagtgtactccatcattctgttttatggtttttgtcttaacaggatacaaactggcatttaattacttaaaagcaaaaagatatgtggattcaattgacatatgtcaccaggttcttgaagcacatccaacttatccaaaaatcagaaaggatatacttgataaggcccgtgcgtctttaagaccttgaaaataattttaacttaggtgttggtttaacaggaaatgaaagaaatctaactttcagttcttcctgttcaaaacaggtttgagctcagtgctttgttattagaagtatacccttttttctccagcagaggttgctgctgtacatcaagagaagtactatgtgaaattggtgtttcctaatggagttgaatgagagctggtctatttgactctgttttgattgggtacagatttggtgactctgtggtaaagactataattatttctataaagaatattttgttaaaatctaggtaattaaataccctgtatcttttctaaggaatattatttcaggaaatatatttaaaatgcattgttctcttttaaagtgtttttgttatattcttttatttatttatttatttttaaagacagagccttgatctgccgcccaggctggagtgcagtggcacgatcttggctcactgcaacctccgcctcctgggtttacgcgattctcctgcttcagcctcccgagtagctgggactaaaggcatgtgccatcacacccggctaattttttgtatttttagtagagatgggatttcaccgtgttagccaggaggggcttgatctcttgaccttgtgatccacctgcctcggcctcccaaagtgctgggattacaggcatgagccaccgcacccagcctgtttttgttgtattctgtgttgtttcaaaaattggaataaatctccctgtaaataactcat

SEQ ID NO: 321980 - DNA, 831 bp, Homo sapiens
caccccccaagttatggaaccctctgatatacatgcccggtatcccgcacctttggaggcccaagccggttgatcacccgaggtaaggaattccggacacacccggcccacatggaggaccccctctcttcttaagatcaccaattacccggccattgtggcgcatgcccgttatccccgctactccggagggttagaaagggaaatcgcctggacacgggaggccgaggtttcactgagctgagattgcgcccttgcactcccagcctgggccaccaaaaccaattttttttccattaaaaaaaaaaaaaaaaaaaaaaacacctaaattatttattgctgataagagtgtgtgctctgtttcatggatcagctttgcaatttccttccaaatattcatctacttgcagaataaatgccatcccttcccacgccaaccatatcgatgatatagtggcaggaaggagagtaagggactctggagcttaaacagaccatcacatgggaaggcagtaaacaagatgctaactgatggagtgaaatccccaggagatgcagaaggcaagtgcagctaactgaggcctcaggggcaggagatgcccatcaggatgagagctatgtctttctccagtgatgactctgcttctatgaggtcaccagcagtagaaccatatcttgctggcatacacttgggatggccccgcctcctggacttccatctgtcatcaggagaacataaccatctggagtcagtacagatcatcaatccttccacatatacaagttcattttaaatttttaaaaatataatacaactgagaagtcttcatt

SEQ ID NO: 321981 - DNA, 767 bp, Homo sapiens
gtgtgagagaatttctgttttactagttaacttaaagtacatttaacaagtaaggccaattataccctataaagttgattctgaggtacacttaaattacattttaacatttctggaattcttataatctctgaagttgagatgactcttaaatgacattttagattcatcaaggtacacatttggaaatgaggtagaatattcacccaaagtgtaacaacagtgttctggtggagggaataatctgccacttaatgaagagccagtgtgtacagctcttcattattcaatgctgggtgcttagtaagtgctcattaatatagtagcagtgaccctctgtagcagctgctgttgtcctagttgtgaaaacatttatctagctaacaatatttacaggctcatctgattttggtcatgggtttagttttaaatttttgaggtttcagaaaattctatcaatttatttcgtaaatattataaatgtactagcatttattcattctgcgttatgagaaaatctccctttctagtgttatttgttcactattttggaagaatgattattttaatttcatctttacagcatgaggcaaccaaagttttacaagatgccatccatgaattttctggaacatctgaagaagtgcgggttaccatgtgctaatgcagaccttgctctagcccaaggagatattgaacgggctttaagcatccttcagaatgttacagccgaacagccttattttatagaggccagagaaaaaatg

SEQ ID NO: 321982 - DNA, 283 bp, Homo sapiens
tgccatcccttcccacgccaaccatatcgatgatatagtggcaggaaggagagtaagggactctggagcttaaacagaccatcacatggtaaggattgagagttgagctttttgttaaaagtatgttgtagatctacattattataaactgatttttctgtttgacctcaagtattttcagcacttttactgtgataggttaactgtcagccataaacatttctaaagaaataggaaaattttcttcctatattattcaaaatacaagtttctggtttatagc

SEQ ID NO: 321983 - DNA, 2894 bp, Homo sapiens
ggaatgaaaagaattggagcttccacaaaatcaaaagacagaaaaactgaagttgatacaagccatcgtttatcgatctttcttgaattgatagacgttcaccgcttaaatggagagcagcatgaggcaaccaaagttttacaagatgccatccatgaattttctggaacatctgaagaagtgcgggttaccatgtgctaatgcagaccttgctctagcccaaggagatattgaacgggctttaagcatccttcagaatgttacagccgaacagccttattttatagaggccagagaaaaaatggcagatatttatctgaagcacagaaaagataaaatgttatatatcacttgttttagagaaattgctgaaagaatggctaaccctcggtcttttcttctccttggtgatgcatacatgaatattctagagcctgaagaagccatagtagcatatgagcaagcattaaatcagaacccgaaagatggaacattggcaagcaaaatgggcaaagcacttatcaaaactcataactactcaatggcaatcacttactatgaagctgctctgaaaactggacaaaagaattatctttgctatgacctggctgagctcttattaaaattgaaatggtatgacaaagcagaaaaagttcttcagcatgctctggctcatgaacctgtaaatgaactgtcagctctcatggaggatggacgttgtcaagttcttctagcaaaagtttatagtaaaatggaaaaacttggtgatgcgatcactgcattacaacaggctcgagaattacaagctcgggtactaaaacgtgttcagatggaacagccagatgcagttcctgcacagaaacatttagcagctgaaatttgtgcagagattgcaaaacattctgttgctcagcgagactatgaaaaagcaattaagttttatagagaggctctggttcactgcgaaacagataataagattatgttggaactggcacgattatacctggcacaagatgaccctgattcctgcctgcggcagtgtgctctactgcttcagagtgaccaggataacgaagctgctaccatgatgatggctgatctcatgttcagaaaacaagactatgaacaagcagtgtttcatttacagcagcttttagaacgtaagccagataattatatgacattatctcgtttgattgatctcctaagaagatgtggaaaactcgaggatgtcccaagatttttctcaatggctgagaaacgtaactccagagcaaaattggaaccaggatttcagtattgtaaaggactgtatctttggtacactggagaaccaaatgatgcccttcgacattttaataaagctcggaaagatcgtgactggggccaaaatgccctttataatatgatagagatctgtttgaatccagataatgaaactgttggaggtgaagtatttgaaaacctggatggagacctgggtaattcaactgagaagcaagaatctgtgcaactggcagtaagaacagcagaaaaacttcttaaggaactaaaacctcagactgttcagggtcacgtacagcttcgcataatggaaaactattgcttaatggctaccaaacagaaatctaatgttgaacaagcattaaataccttcactgaaatagcagcatctgagaaggagcatatcccagcgctcttgggaatggcaacggcttatatgatcttgaaacagactccacgagccagaaaccagctgaagcgtattgcgaaaatgaattggaatgctattgatgctgaagagtttgagaagagttggctgctacttgctgatatttacattcaatcagcaaaatatgacatggcagaagacctgttaaaacggtgcctgcgtcataatagatcttgctgcaaagcttatgaatatatgggatacattatggaaaaagagcaagcatatacagatgctgccttgaactatgagatggcatggaaatatagcaatcggacaaatccggcagtaggatacaaactggcatttaattacttaaaagcaaaaagatatgtggattcaattgacatatgtcaccaggttcttgaagcacatccaacttatccaaaaatcagaaaggatatacttgataaggcccgtgcgtctttaagaccttgaaaataattttaacttaggtgttggtttaacaggaaatgaaagaaatctaactttcagttcttcctgttcaaaacaggatttgattgccttatgtgacaagcccaagatctgtgacagttggagctcaaactaggcagtcttgattccagactgctctgaactagtatttgaaggaactaatgaacatgacatgttaaatgaaagtttggggacgtacactcaggatggaagcagggggacacaacagaaatgaaagaattttctgtagatctgggatctggacacctgccccccgtcatgaataaatgccatcccttcccacgccaaccatatcgatgatatagtggcaggaaggagagtaagggactctggagcttaaacagaccatcacatgggaaggcagtaaacaagatgctaactgatggagtgaaatccccaggagatgcagaaggcaagtgcagctaactgaggcctcaggggcaggagatgcccatcaggatgagagctatgtctttctccagtgatgactctgcttctatgaggtcaccagcagtagaaccatatcttgctggcatacacttgggatggccccgcctcctggacttccatctgtcatcaggagaacataaccatctggagtcagtacagatcatcaatccttccacatatacaagttcattttaaatttttaaaaatataatacaactgagaagtcttcatt

SEQ ID NO: 321984 - DNA, 2925 bp, Homo sapiens
ggaatgaaaagaattggagcttccacaaaatcaaaagacagaaaaactgaagttgatacaagccatcgtttatcgatctttcttgaattgatagacgttcaccgcttaaatggagagcagcatgaggcaaccaaagttttacaagatgccatccatgaattttctggaacatctgaagaagtgcgggttaccatgtgctaatgcagaccttgctctagcccaaggagatattgaacgggctttaagcatccttcagaatgttacagccgaacagccttattttatagaggccagagaaaaaatggcagatatttatctgaagcacagaaaagataaaatgttatatatcacttgttttagagaaattgctgaaagaatggctaaccctcggtcttttcttctccttggtgatgcatacatgaatattctagagcctgaagaagccatagtagcatatgagcaagcattaaatcagaacccgaaagatggaacattggcaagcaaaatgggcaaagcacttatcaaaactcataactactcaatggcaatcacttactatgaagctgctctgaaaactggacaaaagaattatctttgctatgacctggctgagctcttattaaaattgaaatggtatgacaaagcagaaaaagttcttcagcatgctctggctcatgaacctgtaaatgaactgtcagctctcatggaggatggacgttgtcaagttcttctagcaaaagtttatagtaaaatggaaaaacttggtgatgcgatcactgcattacaacaggctcgagaattacaagctcgggtactaaaacgtgttcagatggaacagccagatgcagttcctgcacagaaacatttagcagctgaaatttgtgcagagattgcaaaacattctgttgctcagcgagactatgaaaaagcaattaagttttatagagaggctctggttcactgcgaaacagataataagattatgttggaactggcacgattatacctggcacaagatgaccctgattcctgcctgcggcagtgtgctctactgcttcagagtgaccaggataacgaagctgctaccatgatgatggctgatctcatgttcagaaaacaagactatgaacaagcagtgtttcatttacagcagcttttagaacgtaagccagataattatatgacattatctcgtttgattgatctcctaagaagatgtggaaaactcgaggatgtcccaagatttttctcaatggctgagaaacgtaactccagagcaaaattggaaccaggatttcagtattgtaaaggactgtatctttggtacactggagaaccaaatgatgcccttcgacattttaataaagctcggaaagatcgtgactggggccaaaatgccctttataatatgatagagatctgtttgaatccagataatgaaactgttggaggtgaagtatttgaaaacctggatggagacctgggtaattcaactgagaagcaagaatctgtgcaactggcagtaagaacagcagaaaaacttcttaaggaactaaaacctcagactgttcagggtcacgtacagcttcgcataatggaaaactattgcttaatggctaccaaacagaaatctaatgttgaacaagcattaaataccttcactgaaatagcagcatctgagaaggagcatatcccagcgctcttgggaatggcaacggcttatatgatcttgaaacagactccacgagccagaaaccagctgaagcgtattgcgaaaatgaattggaatgctattgatgctgaagagtttgagaagagttggctgctacttgctgatatttacattcaatcagcaaaatatgacatggcagaagacctgttaaaacggtgcctgcgtcataatagatcttgctgcaaagcttatgaatatatgggatacattatggaaaaagagcaagcatatacagatgctgccttgaactatgagatggcatggaaatatagcaatcggacaaatccggcagtaggatacaaactggcatttaattacttaaaagcaaaaagatatgtggattcaattgacatatgtcaccaggttcttgaagcacatccaacttatccaaaaatcagaaaggatatacttgataaggcccgtgcgtctttaagaccttgaaaataattttaacttaggtgttggtttaacaggaaatgaaagaaatctaactttcagttcttcctgttcaaaacaggtttgagctcagtgctttgttattagaagtatacccttttttctccagcagaggttgctgctgtacatcaagagaagtactatgtgaaattggtgtttcctaatggagttgaatgagagctggtctatttgactctgttttgattgggtacagatttggtgactctgtggtaaagactataattatttctataaagaatattttgttaaaatctaggtaattaaataccctgtatcttttctaaggaatattatttcaggaaatatatttaaaatgcattgttctcttttaaagtgtttttgttatattcttttatttatttatttatttttaaagacagagccttgatctgccgcccaggctggagtgcagtggcacgatcttggctcactgcaacctccgcctcctgggtttacgcgattctcctgcttcagcctcccgagtagctgggactaaaggcatgtgccatcacacccggctaattttttgtatttttagtagagatgggatttcaccgtgttagccaggaggggcttgatctcttgaccttgtgatccacctgcctcggcctcccaaagtgctgggattacaggcatgagccaccgcacccagcctgtttttgttgtattctgtgttgtttcaaaaattggaataaatctccctgtaaataactcat

SEQ ID NO: 321985 - DNA, 1931 bp, Homo sapiens
ggaatgaaaagaattggagcttccacaaaatcaaaagacagaaaaactgaagttgatacaagccatcgtttatcgatctttcttgaattgatagacgttcaccgcttaaatggagagcagcatgaggcaaccaaagttttacaagatgccatccatgaattttctggaacatctgaagaagtgcgggttaccatgtgctaatgcagaccttgctctagcccaaggagatattgaacgggctttaagcatccttcagaatgttacagccgaacagccttattttatagaggccagagaaaaaatggcagatatttatctgaagcacagaaaagataaaatgttatatatcacttgttttagagaaattgctgaaagaatggctaaccctcggtcttttcttctccttggtgatgcatacatgaatattctagagcctgaagaagccatagtagcatatgagcaagcattaaatcagaacccgaaagatggaacattggcaagcaaaatgggcaaagcacttatcaaaactcataactactcaatggcaatcacttactatgaagctgctctgaaaactggacaaaagaattatctttgctatgacctggctgagctcttattaaaattgaaatggtatgacaaagcagaaaaagttcttcagcatgctctggctcatgaacctgtaaatgaactgtcagctctcatggaggatggacgttgtcaagttcttctagcaaaagtttatagtaaaatggaaaaacttggtgatgcgatcactgcattacaacaggctcgagaattacaagctcgggtactaaaacgtgttcagatggaacagccagatgcagttcctgcacagaaacatttagcagctgaaatttgtgcagagattgcaaaacattctgttgctcagcgagactatgaaaaagcaattaagttttatagagaggctctggttcactgcgaaacagataataagattatgttggaactggcacgattatacctggcacaagatgaccctgattcctgcctgcggcagtgtgctctactgcttcagagtgaccaggataacgaagctgctaccatgatgatggctgatctcatgttcagaaaacaagactatgaacaagcagtgtttcatttacagcagcttttagaacgtaagccagataattatatgacattatctcgtttgattgatctcctaagaagatgtggaaaactcgaggatgtcccaagatttttctcaatggctgagaaacgtaactccagagcaaaattggaaccaggatttcagtattgtaaaggactgtatctttggtacactggagaaccaaatgatgcccttcgacattttaataaagctcggaaagatcgtgactggggccaaaatgccctttataatatgatagagatctgtttgaatccagataatgaaactgttggaggtgaagtatttgaaaacctggatggagacctgggtaattcaactgagaagcaagaatctgtgcaactggcagtaagaacagcagaaaaacttcttaaggaactaaaacctcagactgttcagggtcacgtacagcttcgcataatggaaaactattgcttaatggctaccaaacagaaatctaatgttgaacaagcattaaataccttcactgaaatagcagcatctgagaaggagcatatcccagcgctcttgggaatggcaacggcttatatgatcttgaaacagactccacgagccagaaaccagctgaagcgtattgcgaaaatgaattggaatgctattgatgctgaagagtttgagaagagttggctgctacttgctgatatttacattcaatcagcaaaatatgacatggcagaagacctgttaaaacggtgcctgcgtcataatagagtaggtgattgaagagtaaaaaata

SEQ ID NO: 321986 - DNA, 2426 bp, Homo sapiens
gagcgctctcgctcagtgcagcgaggccagcgatgccttctggaccacacgctgtcctcgccgaggtcctggtttgttcctcaacgtcggctgaaggcatcgtcccctgacttcctcttccattcgtccttccgaaaggggacccgactggttcctcttctacatatgaggcgcatctgcttggtgcaaatgtccaagcacctcttctgactcggtgagagtgattttccagtgattgctttggcctgtacaaccagagaacaggattcttcccttctttttggccaccaaatgcctatgtgcaccacacattccagtgtgctgagaagggcagagcttcttggatgatgatggacgtcccaccgggcaggatgaaggcagagcgtgtggcatctccacctcaagggtgcagcctgatcttcctcttctcccttgccagccagcactctgccttctgtatccaccatggtgtttggtgagtttttccatcgccctggacaagacgaggaacttgtcaacctgaatgtggggggctttaagcagtctgttgaccaaagcaccctcctgcggtttcctcacaccagactggggaagctgcttacttgccattctgaagaggccattctggagctgtgtgatgattacagtgtggccgataaggaatactactttgatcggaatccctccttgttcagatatgttttgaatttttattacacggggaagctgcatgtcatggaggagctgtgcgtattctcattctgccaggagatcgagtactggggcatcaacgagctcttcattgattcttgctgcagcaatcgctaccaggaacgcaaggaggaaaaccacgagaaggactgggaccagaaaagccatgatgtgagtaccgactcctcgtttgaagagtcgtctctgtttgagaaagagctggagaagtttgacacactgcgatttggtcagctccggaagaaaatctggattagaatggagaatccagcgtactgcctgtccgctaagcttatcgctatctcctccttgagcgtggtgctggcctccatcgtggccatgtgcgttcacagcatgtcggagttccagaatgaggatggagaagtggatgatccggtgctggaaggagtggagatcgcgtgcattgcctggttcaccggggagcttgccgtccggctggctgccgctccttgtcaaaagaaattctggaaaaaccctctgaacatcattgactttgtctctattattcccttctatgccacgttggctgtagacaccaaggaggaagagagtgaggatattgagaacatgggcaaggtggtccagatcctacggcttatgaggattttccgaattctaaagcttgcccggcactcggtaggacttcggtctctaggtgccacactgagacacagctaccatgaagttgggcttctgcttctcttcctctctgtgggcatttccattttctctgtgcttatctactccgtggagaaagatgaccacacatccagcctcaccagcatccccatctgctggtggtgggccaccatcagcatgacaactgtgggctatggagacacccacccggtcaccttggcgggaaagctcatcgccagcacatgcatcatctgtggcatcttggtggtggcccttcccatcaccatcatcttcaacaagttttccaagtactaccagaagcaaaaggacattgatgtggaccagtgcagtgaggatgcaccagagaagtgtcatgagctaccttactttaacattagggatatatatgcacagcggatgcacgccttcattaccagtctctcttctgtaggcattgtggtgagcgatcctgactccacagatgcttcaagcattgaagacaatgaggacatttgtaacaccacctccttggagaattgcacagcaaaatgagcgggggtgtttgtgcctgtttctcttatcctttcccaacattaggttaacacagctttataaacctcagtgggttcgttaaaatcatttaattctcagggtgtacctttcagccatagttggacattcattgctgaattctgaaatgatagaattgtctttatttttctctgtgaggtcaattaaatgccttgttctgaaatttattttttacaagagagagttgtgatatagtttggaatataagataaatggtattgggtggggtttgtggctacagcttatgcatcattctgtgtttgtcatttactcacattgagctaactttaaattactgacaagtagaatcaaaggtgcagctgactgagacgacatgcatgtaagatccacaaaatgagacaatgcatgtaaatccatgctcatgttctaaacatggaaactaggagcctaataaacttcctaattcagtatggaaaaaaaaaaaa

SEQ ID NO: 321987 - DNA, 1392 bp, Homo sapiens
agaccggccgacgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtgagagtgattttccagtgattgctttggcctgtacaaccagagaacaggattcttcccttctttttggccaccaaatgcctatgtgcaccacacattccagtgtgctgagaagggcagagcttcttggatgatgatggacgtcccaccgggcaggatgaaggcagagcgtgtggcatctccacctcaagggtgcagcctgatcttcctcttctcccttgccagccagcactctgccttctgtatccaccatggtgtttggtgagtttttccatcgccctggacaagacgaggaacttgtcaacctgaatgtggggggctttaagcagtctgttgaccaaagcaccctcctgcggtttcctcacaccagactggggaagctgcttacttgccattctgaagaggccattctggagctgtgtgatgattacagtgtggccgataaggaatactactttgatcggaatccctccttgttcagatatgttttgaatttttattacacggggaagctgcatgtcatggaggagctgtgcgtattctcattctgccaggagatcgagtactggggcatcaacgagctcttcattgattcttgctgcagcaatcgctaccaggaacgcaaggaggaaaaccacgagaaggactgggaccagaaaagccatgatgtgagtaccgactcctcgtttgaagagtcgtctctgtttgagaaagagctggagaagtttgacacactgcgatttggtcagctccggaagaaaatctggattagaatggagaatccagcgtactgcctgtccgctaagcttatcgctatctcctccttgagcgtggtgctggcctccatcgtggccatgtgcgttcacagcatgtcggagttccagaatgaggatggagaagtggatgatccggtgctggaaggagtggagatcgcgtgcattgcctggttcaccggggagcttgccgtccggctggctgccgctccttgtcaaaagaaattctggaaaaaccctctgaacatcattgactttgtctctattattcccttttatgcatcattctgtgtttgtcatttactcacattgagctaactttaaattactgacaagtagaatcaaaggtgcagctgactgagacgacatgcatgtaagatccacaaaatgagacaatgcatgtaaatccatgctcatgttctaaacatggaaactaggagcctaataaacttcctaattcagtatggaaaaaaaaaaaa

SEQ ID NO: 321988 - DNA, 2352 bp, Homo sapiens
agaccggccgacgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtgagagtgattttccagtgattgctttggcctgtacaaccagagaacaggattcttcccttctttttggccaccaaatgcctatgtgcaccacacattccagtgtgctgagaagggcagagcttcttggatgatgatggacgtcccaccgggcaggatgaaggcagagcgtgtggcatctccacctcaagggtgcagcctgatcttcctcttctcccttgccagccagcactctgccttctgtatccaccatggtgtttggtgagtttttccatcgccctggacaagacgaggaacttgtcaacctgaatgtggggggctttaagcagtctgttgaccaaagcaccctcctgcggtttcctcacaccagactggggaagctgcttacttgccattctgaagaggccattctggagctgtgtgatgattacagtgtggccgataaggaatactactttgatcggaatccctccttgttcagatatgttttgaatttttattacacggggaagctgcatgtcatggaggagctgtgcgtattctcattctgccaggagatcgagtactggggcatcaacgagctcttcattgattcttgctgcagcaatcgctaccaggaacgcaaggaggaaaaccacgagaaggactgggaccagaaaagccatgatgtgagtaccgactcctcgtttgaagagtcgtctctgtttgagaaagagctggagaagtttgacacactgcgatttggtcagctccggaagaaaatctggattagaatggagaatccagcgtactgcctgtccgctaagcttatcgctatctcctccttgagcgtggtgctggcctccatcgtggccatgtgcgttcacagcatgtcggagttccagaatgaggatggagaagtggatgatccggtgctggaaggagtggagatcgcgtgcattgcctggttcaccggggagcttgccgtccggctggctgccgctccttgtcaaaagaaattctggaaaaaccctctgaacatcattgactttgtctctattattcccttctatgccacgttggctgtagacaccaaggaggaagagagtgaggatattgagaacatgggcaaggtggtccagatcctacggcttatgaggattttccgaattctaaagcttgcccggcactcggtaggacttcggtctctaggtgccacactgagacacagctaccatgaagttgggcttctgcttctcttcctctctgtgggcatttccattttctctgtgcttatctactccgtggagaaagatgaccacacatccagcctcaccagcatccccatctgctggtggtgggccaccatcagcatgacaactgtgggctatggagacacccacccggtcaccttggcgggaaagctcatcgccagcacatgcatcatctgtggcatcttggtggtggcccttcccatcaccatcatcttcaacaagttttccaagtactaccagaagcaaaaggacattgatgtggaccagtgcagtgaggatgcaccagagaagtgtcatgagctaccttactttaacattagggatatatatgcacagcggatgcacgccttcattaccagtctctcttctgtaggcattgtggtgagcgatcctgactccacagatgcttcaagcattgaagacaatgaggacatttgtaacaccacctccttggagaattgcacagcaaaatgagcgggggtgtttgtgcctgtttctcttatcctttcccaacattaggttaacacagctttataaacctcagtgggttcgttaaaatcatttaattctcagggtgtacctttcagccatagttggacattcattgctgaattctgaaatgatagaattgtctttatttttctctgtgaggtcaattaaatgccttgttctgaaatttattttttacaagagagagttgtgatatagtttggaatataagataaatggtattgggtggggtttgtggctacagcttatgcatcattctgtgtttgtcatttactcacattgagctaactttaaattactgacaagtagaatcaaaggtgcagctgactgagacgacatgcatgtaagatccacaaaatgagacaatgcatgtaaatccatgctcatgttctaaacatggaaactaggagcctaataaacttcctaattcagtatggaaaaaaaaaaaa

SEQ ID NO: 321989 - DNA, 1972 bp, Homo sapiens
agaccggccgacgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtgagagtgattttccagtgattgctttggcctgtacaaccagagaacaggattcttcccttctttttggccaccaaatgcctatgtgcaccacacattccagtgtgctgagaagggcagagcttcttggatgatgatggacgtcccaccgggcaggatgaaggcagagcgtgtggcatctccacctcaagggtgcagcctgatcttcctcttctcccttgccagccagcactctgccttctgtatccaccatggtgtttggtgagtttttccatcgccctggacaagacgaggaacttgtcaacctgaatgtggggggctttaagcagtctgttgaccaaagcaccctcctgcggtttcctcacaccagactggggaagctgcttacttgccattctgaagaggccattctggagctgtgtgatgattacagtgtggccgataaggaatactactttgatcggaatccctccttgttcagatatgttttgaatttttattacacggggaagctgcatgtcatggaggagctgtgcgtattctcattctgccaggagatcgagtactggggcatcaacgagctcttcattgattcttgctgcagcaatcgctaccaggaacgcaaggaggaaaaccacgagaaggactgggaccagaaaagccatgatgtgagtaccgactcctcgtttgaagagtcgtctctgtttgagaaagagctggagaagtttgacacactgcgatttggtcagctccggaagaaaatctggattagaatggagaatccagcgtactgcctgtccgctaagcttatcgctatctcctccttgagcgtggtgctggcctccatcgtggccatgtgcgttcacagcatgtcggagttccagaatgaggatggagaagtggatgatccggtgctggaaggagtggagatcgcgtgcattgcctggttcaccggggagcttgccgtccggctggctgccgctccttgtcaaaagaaattctggaaaaaccctctgaacatcattgactttgtctctattattcccttctatgccacgttggctgtagacaccaaggaggaagagagtgaggatattgagaacatgggcaaggtggtccagatcctacggcttatgaggattttccgaattctaaagcttgcccggcactcggtaggacttcggtctctaggtgccacactgagacacagctaccatgaagttgggcttctgcttctcttcctctctgtgggcatttccattttctctgtgcttatctactccgtggagaaagatgaccacacatccagcctcaccagcatccccatctgctggtggtgggccaccatcagcatgacaactgtgggctatggagacacccacccggtcaccttggcgggaaagctcatcgccagcacatgcatcatctgtggcatcttggtggtggcccttcccatcaccatcatcttcaacaagttttccaagtactaccagaagcaaaaggacattgatgtggaccagtgcagtgaggatgcaccagagaagtgtcatgagctaccttactttaacattagggatatattttggaatataagataaatggtattgggtggggtttgtggctacagcttatgcatcattctgtgtttgtcatttactcacattgagctaactttaaattactgacaagtagaatcaaaggtgcagctgactgagacgacatgcatgtaagatccacaaaatgagacaatgcatgtaaatccatgctcatgttctaaacatggaaactaggagcctaataaacttcctaattcagtatggaaaaaaaaaaaa

SEQ ID NO: 321990 - DNA, 182 bp, Homo sapiens
catgctcttgaggctgtatggtcgccactccccattccattccagaggagggcacagaggccggactgtcgcagtcctcactttagtgggtgaggacacctgcctccaacccactacctacctcagaagcctgcaggctttttcttattacataccccacccaaagacctaaaaaaaaaaaa

SEQ ID NO: 321991 - DNA, 230 bp, Homo sapiens
agagtgagactctgtctcaaaaaaaaaaaacaaacaaacaaaaaaaacaaaaccatatgcttcaacacctcaggttgaccatttggggggagtgtgtatgggtgttttaagatggcggggtatgcagatttactctgtcttcacacaaaagcctgatgctaaggaagcagctgagaaagtgagaaaagagtgtttgaagacaagttcttgttaaatatcaaattttacaa

SEQ ID NO: 321992 - DNA, 177 bp, Homo sapiens
atcagagaggtggggctggggtataagccaggctgtagacctcagagcctgtgttccaaagttacatcatatgacctgaagacacccctgtacaccctatcctcacccacccccagataatctagaccagcttcctttgcaattagttcagcatttgctgagcccacagtctgttgg

SEQ ID NO: 321993 - DNA, 5118 bp, Homo sapiens
cgcgccgccgccgccgccttctgtgcagtcgcggcccgggcggacggtggctggctgctccgcagcgctcggctggctgcagcggcaccgcgggttgcgcggccggggatgctccagcgggcgcgatggcccccgccatgcagccggccgagatccaatttgcccagcggctggcgtccagcgagaagggcatccgggaccgagcggtgaagaagctgcgccagtacatcagcgtgaagacgcagagggagacaggaggtttcagtcaggaagaacttctgaaaatctggaaggggctcttctactgcatgtgggtgcaggatgaaccccttctacaggaagagctcgccaacaccattgcacagctagtccatgctgttaacaactcagcggctcaacacctgttcattcagaccttttggcaaaccatgaatcgagaatggaaaggaatagacaggctacgcctggacaaatactatatgctgattcgtctggtcctgaggcagtcctttgaagtcttgaagcgaaatggctgggaagaaagccgaatcaaggttttcttggatgtcctgatgaaggaggtcctgtgtcctgagagtcagtctcctaatggagtgagattccacttcattgatatttacctggatgaactctccaaagtcggggggaaggagcttttagcagatcagaatctcaagtttatcgatccattctgcaaaattgctgcaaagacgaaggaccacaccctggtacagaccatagctcggggtgtcttcgaagctatcgtagatcagtctccttttgtgcctgaagagacgatggaggaacagaagacaaaagtgggtgatggtgacctctctgctgaggagatacctgaaaatgaggtatccttgagaagagctgtcagtaaaaagaagacagcactgggcaaaaaccattccagaaaagatggactcagtgatgaaagaggaagagatgactgtggaacctttgaggacacagggccccttctccagtttgactataaggctgttgctgatcgactcctggaaatgaccagcaggaagaacacgccccacttcaacaggaagcgcctctccaaactcatcaagaaattccaagacctttctgaaggaagcagtatatctcaactcagttttgcggaggacatttctgctgatgaagatgaccaaatcctcagtcaaggaaagcataagaagaaaggaaataaacttttagagaaaactaacttggaaaaggagaaaggaagcagagtcttttgtgtagaggaagaggacagtgaaagcagtcttcaaaagagaagaaggaagaagaagaagaagcaccacctgcagcctgaaaatccaggcccagggggtgcagccccgtccctggaacagaaccggggcagggagcccgaggcctctgggccgaaagccctgaaggcacgtgtggccgagccaggtgcagaggccacgtccagcactggggaggagagtggctccgagcatcctccagccgtccccatgcacaataaaaggaaacggccacggaagaagagcccgagggcccacagggaaatgttggaatcagcagtgttgcccccagaggacatgtctcagagtggcccgagtggcagtcatcctcagggacctagagggtccccgacaggtggagcccaactcctaaaaaggaagcggaaacttggagttgtgcccgtcaatggcagtggcctgtccacgccggcctggcctccattgcagcaggaaggccctcccacaggccccgcagagggggcgaacagccacaccacgctgccccagcgcaggaggctgcagaaaaagaaggcagggcccggcagcctggagctctgtggcctgcccagccagaaaacagcaagtttgaaaaagaggaagaaaatgagagtgatgtcaaacttggtggagcacaacggggtgctggagtccgaagctgggcaaccccaggctctgggaagcagtgggacttgcagttccctgaagaagcagaagctgagggcagagagcgactttgtgaagtttgacacccccttcttaccaaagcccctgttcttcagaagagccaagagcagcactgccacccaccctccaggccctgccgtccagctaaacaagacaccatccagctccaagaaagtcacctttgggctgaacagaaacatgactgccgaattcaagaagacagacaagagtatcttggtcagtcccacgggcccttctcgagtggccttcgaccctgaacagaagcccctccacggggtgctgaagacccccaccagctcacctgccagctcacccctggtggccaagaagcccctgaccaccacaccaaggagaaggcccagggctatggatttcttctgaggagcagcagagtcccttgtaaaagactgcttttgtacagaatgcgctataaattatacctttaagaatgtggggccttttttatgattttgtaagttcccataagttgtgtgcacgaggttctgagagtgcccgcaggctgctgcgtcctggcccctctgtagtggctgcgggcgtcttggttgaatcttttgctacaaaccatgtttgcgtttgagctctccaggattttacatttttgggtaacctcagtgattcccattggtgtaggaaatgagaccctctctgaagctgaggagagcacgttgatctgaactttaaatcaatcagtgctgctggcacaatgaaaggtggaactgcacttctgttgagctctcagttctgcggaatttggtactcattaccgtattcgccgtactaagttggtttctgttagtcttaacagtctgttttcttttaaaagcatgtagggcttcattgccatgttctgtgggtgtttggcaggttaccgatggggaagattcttgtcacagaatcagcaataccatagtttttctacatgtgctcagctgggggtgtggacaggtaggggtggggaaagaagaggctctgcgttctgggggctttttcttctcctccccctacccggtttccctccctgttttcctacctctacggcaagcccaaagtgtcttcccgggagcccagcgcagcccccggctcttacccaggaccccgccccgtgctgagccttctgctgaggtccttgcgtggagcacactcattcctccaagcccttgcgctcccgtttctctctctctccgtccacgttccagccgagtcactgcctgcctgaccggctccatggcagctccccatcttccctagaggctgcctgcgcatctggagcctgcgctccggctcagcgacctttcctctcaaatgcggaagcgtgcacttacagttcagaccgttctcctgtaagttcattacaaacacgggcggaaggcactcaggctttcgttggagaaacagaaataaggccttcttttgagcagcgattgctggatcattgatctgtttgaggaagtgtctgacctgggcctgagagctggagaaggtgcagattcaaagtgagcggctcctgaggagagccgccaaggctgctcgccttctccgtggcttccgcagctaccgtctgcacggtgagagggcacgggcacacggttcgggctggcgtgcagctctcccagccagccacgctctgctcaggcctggaagtgaaagccgcctccttcccgttatgccccccatacaggagcctcggtttttcagcaaaacgcggccagtccccttctccactgctgcctcccagcagagggccccaggatctccaaggtcccagctatggctttggacaacgtggcttcggcccctggggttgcagagcttgcattgggtttacctcggtctcattcattcatggagccaagggtggggtttcacctgcgaacatcagactgacttgctggcgtcaagagcagttgactcactgatgaaggccctggtgaggagaaagcactctgttcttcgcctactctgtaatcgttttgtcataatgagccatgaaaaaagtaatgaacttgtgctgttaatcgtcactgtaatgagaagtcttacgtacaacatagctgtggtggctgcgtggtttaatggctgcattagataggatcctcacatcccattcagaaccaaaactgatacagtgaaacaattaaggtgagcaaatagttttaacttttctttttttttttaagtttcattcttcctagaatatttttctaacaatttttatttcagctttaaagatgggtcatatagccaaacgggccatataatccaacattgttgagatgtcttaggacatctaaggcaaaactggcacatttgttctgcagactattgcaggaatgttttttcctagcatttctatattatctgtccattctgaggaaccagtgaatgtcctataaatgcacctcctgtcaaaaccatgcctgagaggtcccggctgggagtgacagggtgcttcttagattctattggtccttctctcattctccgaacttactcctttttatgggtaagtcaactaggtttacagtcccttatttttaatgcctaagttttgacagcaggaagaaaacaattttttaaaaattctcattacatagacgcacaagaatatgtcacataaagaaaatgtgtttagaatactggttttctatttacgcatgatattttcctaagtaaaattgccaagtggacttggaagtccagaaaggaaaataatttaaattaatgctggtgatcttaacaatattttgtaaaatgatgcttcccccttctccatggtctagtcaattttgtacaattaggtatctgactttacaagtttgttatcctttctaatttttactgaactgaaagcacaaagaagactacacagaaaatctggaaacagttgcaggtgttgggaggaagatgaaatcgagctgtcttttaacttttgtatgtgttttatcagaatttgctggactatgctggcaaggactttgtttacgatcaaattgtactagtgtctgcagggtttgtcagtactcgtcaaagccaagtccaattaaaaaaaaaagtctttgccctccaaaaaaaaatt

SEQ ID NO: 321994 - DNA, 4583 bp, Homo sapiens
cgcgccgccgccgccgccttctgtgcagtcgcggcccgggcggacggtggctggctgctccgcagcgctcggctggctgcagcggcaccgcgggttgcgcggccggggatgctccagcgggcgcgatggcccccgccatgcagccggccgagatccaatttgcccagcggctggcgtccagcgagaagggcatccgggaccgagcggtgaagaagctgcgccagtacatcagcgtgaagacgcagagggagacaggaggtttcagtcaggaagaacttctgaaaatctggaaggggctcttctactgcatgtgggtgcaggatgaaccccttctacaggaagagctcgccaacaccattgcacagctagtccatgctgttaacaactcagcggctcaacacctgttcattcagaccttttggcaaaccatgaatcgagaatggaaaggaatagacaggctacgcctggacaaatactatatgctgattcgtctggtcctgaggcagtcctttgaagtcttgaagcgaaatggctgggaagaaagccgaatcaaggttttcttggatgtcctgatgaaggaggtcctgtgtcctgagagtcagtctcctaatggagtgagattccacttcattgatatttacctggatgaactctccaaagtcggggggaaggagcttttagcagatcagaatctcaagtttatcgatccattctgcaaaattgctgcaaagacgaaggaccacaccctggtacagaccatagctcggggtgtcttcgaagctatcgtagatcagtctccttttgtgcctgaagagacgatggaggaacagaagacaaaagtgggtgatggtgacctctctgctgaggagatacctgaaaatgaggtatccttgagaagagctgtcagtaaaaagaagacagcactgggcaaaaaccattccagaaaagatggactcagtgatgaaagaggaagagatgactgtggaacctttgaggacacagggccccttctccagtttgactataaggctgttgctgatcgactcctggaaatgaccagcaggaagaacacgccccacttcaacaggaagcgcctctccaaactcatcaagaaattccaagacctttctgaaggaagcagtatatctcaactcagttttgcggaggacatttctgctgatgaagatgaccaaatcctcagtcaaggaaagcataagaagaaaggaaataaacttttagagaaaactaacttggaaaaggagaaaggaagcagagtcttttgtgtagaggaagaggacagtgaaagcagtcttcaaaagagaagaaggaagaagaagaagaagcaccacctgcagcctgaaaatccaggcccagggggtgcagccccgtccctggaacagaaccggggcagggagcccgaggcctctgggccgaaagccctgaaggcacgtgtggccgagccaggtgcagaggccacgtccagcactggggaggagagtggctccgagcatcctccagccgtccccatgcacaataaaaggaaacggccacggaagaagagcccgagggcccacagggaaatgttggaatcagcagtgttgcccccagaggacatgtctcagagtggcccgagtggcagtcatcctcagggacctagagggtccccgacaggtggagcccaactcctaaaaaggaagcggaaacttggagttgtgcccgtcaatggcagtggcctgtccacgccggcctggcctccattgcagcaggaaggccctcccacaggccccgcagagggggcgaacagccacaccacgctgccccagcgcaggaggctgcagaaaaagaaggcagggcccggcagcctggagctctgtggcctgcccagccagaaaacagcaagtttgaaaaagaggaagaaaatgagagtgatgtcaaacttggtggagcacaacggggtgctggagtccgaagctgggcaaccccaggctctgggaagcagtgggacttgcagttccctgaagaagcagaagctgagggcagagagcgactttgtgaagtttgacacccccttcttaccaaagcccctgttcttcagaagagccaagagcagcactgccacccaccctccaggccctgccgtccagctaaacaagacaccatccagctccaagaaagtcacctttgggctgaacagaaacatgactgccgaattcaagaagacagacaagagtatcttggtcagtcccacgggcccttctcgagtggccttcgaccctgaacagaagcccctccacggggtgctgaagacccccaccagctcacctgccagctcacccctggtggccaagaagcccctgaccaccacaccaaggagaaggcccagggctatggatttcttctgaggagcagcagagtcccttgtaaaagactgcttttgtacagaatgcgctataaattatacctttaagaatgtggggccttttttatgattttgtaagttcccataagttgtgtgcacgaggttctgagagtgcccgcaggctgctgcgtcctggcccctctgtagtggctgcgggcgtcttggttgaatcttttgctacaaaccatgtttgcgtttgagctctccaggattttacatttttgggtaacctcagtgattcccattggtgtaggaaatgagaccctctctgaagctgaggagagcacgttgatctgaactttaaatcaatcagtgctgctggcacaatgaaaggtggaactgcacttctgttgagctctcagttctgcggaatttggtactcattaccgtattcgccgtactaagttggtttctgttagtcttaacagtctgttttcttttaaaagcatgtagggcttcattgccatgttctgtgggtgtttggcaggttaccgatggggaagattcttgtcacagaatcagcaataccatagtttttctacatgtgctcagctgggggtgtggacaggtaggggtggggaaagaagaggctctgcgttctgggggctttttcttctcctccccctacccggtttccctccctgttttcctacctctacggcaagcccaaagtgtcttcccgggagcccagcgcagcccccggctcttacccaggaccccgccccgtgctgagccttctgctgaggtccttgcgtggagcacactcattcctcggtttttcagcaaaacgcggccagtccccttctccactgctgcctcccagcagagggccccaggatctccaaggtcccagctatggctttggacaacgtggcttcggcccctggggttgcagagcttgcattgggtttacctcggtctcattcattcatggagccaagggtggggtttcacctgcgaacatcagactgacttgctggcgtcaagagcagttgactcactgatgaaggccctggtgaggagaaagcactctgttcttcgcctactctgtaatcgttttgtcataatgagccatgaaaaaagtaatgaacttgtgctgttaatcgtcactgtaatgagaagtcttacgtacaacatagctgtggtggctgcgtggtttaatggctgcattagataggatcctcacatcccattcagaaccaaaactgatacagtgaaacaattaaggtgagcaaatagttttaacttttctttttttttttaagtttcattcttcctagaatatttttctaacaatttttatttcagctttaaagatgggtcatatagccaaacgggccatataatccaacattgttgagatgtcttaggacatctaaggcaaaactggcacatttgttctgcagactattgcaggaatgttttttcctagcatttctatattatctgtccattctgaggaaccagtgaatgtcctataaatgcacctcctgtcaaaaccatgcctgagaggtcccggctgggagtgacagggtgcttcttagattctattggtccttctctcattctccgaacttactcctttttatgggtaagtcaactaggtttacagtcccttatttttaatgcctaagttttgacagcaggaagaaaacaattttttaaaaattctcattacatagacgcacaagaatatgtcacataaagaaaatgtgtttagaatactggttttctatttacgcatgatattttcctaagtaaaattgccaagtggacttggaagtccagaaaggaaaataatttaaattaatgctggtgatcttaacaatattttgtaaaatgatgcttcccccttctccatggtctagtcaattttgtacaattaggtatctgactttacaagtttgttatcctttctaatttttactgaactgaaagcacaaagaagactacacagaaaatctggaaacagttgcaggtgttgggaggaagatgaaatcgagctgtcttttaacttttgtatgtgttttatcagaatttgctggactatgctggcaaggactttgtttacgatcaaattgtactagtgtctgcagggtttgtcagtactcgtcaaagccaagtccaattaaaaaaaaaagtctttgccctccaaaaaaaaatt

SEQ ID NO: 321995 - DNA, 5149 bp, Homo sapiens
  misc_feature (16)..(16): n is a, c, g, or t
aaatagccagttgtanacccgaggttataaatgaggcagtactataacggtctaaggtagcgaaggctgggtggctggtggctggctgctccgcagcgctcggctggctgcagcggcaccgcgggttgcgcggccggggatgctccagcgggcgcgatggcccccgccatgcagccggccgagatccaatttgcccagcggctggcgtccagcgagaagggcatccgggaccgagcggtgaagaagctgcgccagtacatcagcgtgaagacgcagagggagacaggaggtttcagtcaggaagaacttctgaaaatctggaaggggctcttctactgcatgtgggtgcaggatgaaccccttctacaggaagagctcgccaacaccattgcacagctagtccatgctgttaacaactcagcggctcaacacctgttcattcagaccttttggcaaaccatgaatcgagaatggaaaggaatagacaggctacgcctggacaaatactatatgctgattcgtctggtcctgaggcagtcctttgaagtcttgaagcgaaatggctgggaagaaagccgaatcaaggttttcttggatgtcctgatgaaggaggtcctgtgtcctgagagtcagtctcctaatggagtgagattccacttcattgatatttacctggatgaactctccaaagtcggggggaaggagcttttagcagatcagaatctcaagtttatcgatccattctgcaaaattgctgcaaagacgaaggaccacaccctggtacagaccatagctcggggtgtcttcgaagctatcgtagatcagtctccttttgtgcctgaagagacgatggaggaacagaagacaaaagtgggtgatggtgacctctctgctgaggagatacctgaaaatgaggtatccttgagaagagctgtcagtaaaaagaagacagcactgggcaaaaaccattccagaaaagatggactcagtgatgaaagaggaagagatgactgtggaacctttgaggacacagggccccttctccagtttgactataaggctgttgctgatcgactcctggaaatgaccagcaggaagaacacgccccacttcaacaggaagcgcctctccaaactcatcaagaaattccaagacctttctgaaggaagcagtatatctcaactcagttttgcggaggacatttctgctgatgaagatgaccaaatcctcagtcaaggaaagcataagaagaaaggaaataaacttttagagaaaactaacttggaaaaggagaaaggaagcagagtcttttgtgtagaggaagaggacagtgaaagcagtcttcaaaagagaagaaggaagaagaagaagaagcaccacctgcagcctgaaaatccaggcccagggggtgcagccccgtccctggaacagaaccggggcagggagcccgaggcctctgggccgaaagccctgaaggcacgtgtggccgagccaggtgcagaggccacgtccagcactggggaggagagtggctccgagcatcctccagccgtccccatgcacaataaaaggaaacggccacggaagaagagcccgagggcccacagggaaatgttggaatcagcagtgttgcccccagaggacatgtctcagagtggcccgagtggcagtcatcctcagggacctagagggtccccgacaggtggagcccaactcctaaaaaggaagcggaaacttggagttgtgcccgtcaatggcagtggcctgtccacgccggcctggcctccattgcagcaggaaggccctcccacaggccccgcagagggggcgaacagccacaccacgctgccccagcgcaggaggctgcagaaaaagaaggcagggcccggcagcctggagctctgtggcctgcccagccagaaaacagcaagtttgaaaaagaggaagaaaatgagagtgatgtcaaacttggtggagcacaacggggtgctggagtccgaagctgggcaaccccaggctctgggaagcagtgggacttgcagttccctgaagaagcagaagctgagggcagagagcgactttgtgaagtttgacacccccttcttaccaaagcccctgttcttcagaagagccaagagcagcactgccacccaccctccaggccctgccgtccagctaaacaagacaccatccagctccaagaaagtcacctttgggctgaacagaaacatgactgccgaattcaagaagacagacaagagtatcttggtcagtcccacgggcccttctcgagtggccttcgaccctgaacagaagcccctccacggggtgctgaagacccccaccagctcacctgccagctcacccctggtggccaagaagcccctgaccaccacaccaaggagaaggcccagggctatggatttcttctgaggagcagcagagtcccttgtaaaagactgcttttgtacagaatgcgctataaattatacctttaagaatgtggggccttttttatgattttgtaagttcccataagttgtgtgcacgaggttctgagagtgcccgcaggctgctgcgtcctggcccctctgtagtggctgcgggcgtcttggttgaatcttttgctacaaaccatgtttgcgtttgagctctccaggattttacatttttgggtaacctcagtgattcccattggtgtaggaaatgagaccctctctgaagctgaggagagcacgttgatctgaactttaaatcaatcagtgctgctggcacaatgaaaggtggaactgcacttctgttgagctctcagttctgcggaatttggtactcattaccgtattcgccgtactaagttggtttctgttagtcttaacagtctgttttcttttaaaagcatgtagggcttcattgccatgttctgtgggtgtttggcaggttaccgatggggaagattcttgtcacagaatcagcaataccatagtttttctacatgtgctcagctgggggtgtggacaggtaggggtggggaaagaagaggctctgcgttctgggggctttttcttctcctccccctacccggtttccctccctgttttcctacctctacggcaagcccaaagtgtcttcccgggagcccagcgcagcccccggctcttacccaggaccccgccccgtgctgagccttctgctgaggtccttgcgtggagcacactcattcctccaagcccttgcgctcccgtttctctctctctccgtccacgttccagccgagtcactgcctgcctgaccggctccatggcagctccccatcttccctagaggctgcctgcgcatctggagcctgcgctccggctcagcgacctttcctctcaaatgcggaagcgtgcacttacagttcagaccgttctcctgtaagttcattacaaacacgggcggaaggcactcaggctttcgttggagaaacagaaataaggccttcttttgagcagcgattgctggatcattgatctgtttgaggaagtgtctgacctgggcctgagagctggagaaggtgcagattcaaagtgagcggctcctgaggagagccgccaaggctgctcgccttctccgtggcttccgcagctaccgtctgcacggtgagagggcacgggcacacggttcgggctggcgtgcagctctcccagccagccacgctctgctcaggcctggaagtgaaagccgcctccttcccgttatgccccccatacaggagcctcggtttttcagcaaaacgcggccagtccccttctccactgctgcctcccagcagagggccccaggatctccaaggtcccagctatggctttggacaacgtggcttcggcccctggggttgcagagcttgcattgggtttacctcggtctcattcattcatggagccaagggtggggtttcacctgcgaacatcagactgacttgctggcgtcaagagcagttgactcactgatgaaggccctggtgaggagaaagcactctgttcttcgcctactctgtaatcgttttgtcataatgagccatgaaaaaagtaatgaacttgtgctgttaatcgtcactgtaatgagaagtcttacgtacaacatagctgtggtggctgcgtggtttaatggctgcattagataggatcctcacatcccattcagaaccaaaactgatacagtgaaacaattaaggtgagcaaatagttttaacttttctttttttttttaagtttcattcttcctagaatatttttctaacaatttttatttcagctttaaagatgggtcatatagccaaacgggccatataatccaacattgttgagatgtcttaggacatctaaggcaaaactggcacatttgttctgcagactattgcaggaatgttttttcctagcatttctatattatctgtccattctgaggaaccagtgaatgtcctataaatgcacctcctgtcaaaaccatgcctgagaggtcccggctgggagtgacagggtgcttcttagattctattggtccttctctcattctccgaacttactcctttttatgggtaagtcaactaggtttacagtcccttatttttaatgcctaagttttgacagcaggaagaaaacaattttttaaaaattctcattacatagacgcacaagaatatgtcacataaagaaaatgtgtttagaatactggttttctatttacgcatgatattttcctaagtaaaattgccaagtggacttggaagtccagaaaggaaaataatttaaattaatgctggtgatcttaacaatattttgtaaaatgatgcttcccccttctccatggtctagtcaattttgtacaattaggtatctgactttacaagtttgttatcctttctaatttttactgaactgaaagcacaaagaagactacacagaaaatctggaaacagttgcaggtgttgggaggaagatgaaatcgagctgtcttttaacttttgtatgtgttttatcagaatttgctggactatgctggcaaggactttgtttacgatcaaattgtactagtgtctgcagggtttgtcagtactcgtcaaagccaagtccaattaaaaaaaaaagtctttgccctccaaaaaaaaatt

SEQ ID NO: 321996 - DNA, 1281 bp, Homo sapiens
cgcgccgccgccgccgccttctgtgcagtcgcggcccgggcggacggtggctggctgctccgcagcgctcggctggctgcagcggcaccgcgggttgcgcggccggggatgctccagcgggcgcgatggcccccgccatgcagccggccgagatccaatttgcccagcggctggcgtccagcgagaagggcatccgggaccgagcggtgaagaagctgcgccagtacatcagcgtgaagacgcagagggagacaggaggtttcagtcaggaagaacttctgaaaatctggaaggggctcttctactgcatgtgggtgcaggatgaaccccttctacaggaagagctcgccaacaccattgcacagctagtccatgctgttaacaactcagcggctcaacacctgttcattcagaccttttggcaaaccatgaatcgagaatggaaaggaatagacaggctacgcctggacaaatactatatgctgattcgtctggtcctgaggcagtcctttgaagtcttgaagcgaaatggctgggaagaaagccgaatcaaggttttcttggatgtcctgatgaaggaggtcctgtgtcctgagagtcagtctcctaatggagtgagattccacttcattgatatttacctggatgaactctccaaagtcggggggaaggagcttttagcagatcagaatctcaagtttatcgatccattctgcaaaattgctgcaaagacgaaggaccacaccctggtacagaccatagctcggggtgtcttcgaagctatcgtagatcagtctccttttgtgcctgaagagacgatggaggaacagaagacaaaagtgggtgatggtgacctctctgctgaggagatacctgaaaatgaggtatccttgagaagagctgtcagtaaaaagaagacagcactgggcaaaaaccattccagaaaagatggactcagtgatgaaagaggaagagatgactgtggaacctttgaggacacagggccccttctccagtttgactataaggctgttgctgatcgactcctggaaatgaccagcaggaagaacacgccccacttcaacaggaagcgcctctccaaactcatcaagaaattccaagacctttctgaaggaagcagtatatctcaactcagttttgcggaggacatttctgctgatgaagatgaccaaatcctcagtcaaggaagctaaagaggaggaataaatctgagagaaatcatcggaaaggaagcgagcatatctgtgtgagagagacgca

SEQ ID NO: 321997 - DNA, 987 bp, Homo sapiens
  misc_feature (16)..(16): n is a, c, g, or t
aaatagccagttgtanacccgaggttataaatgaggcagtactataacggtctaaggtagcgaaggctgggtggctggtggctggctgctccgcagcgctcggctggctgcagcggcaccgcgggttgcgcggccggggatgctccagcgggcgcgatggcccccgccatgcagccggccgagatccaatttgcccagcggctggcgtccagcgagaagggcatccgggaccgagcggtgaagaagctgcgccagtacatcagcgtgaagacgcagagggagacaggaggtttcagtcaggaagaacttctgaaaatctggaaggggctcttctactgcatgtgggtgcaggatgaaccccttctacaggaagagctcgccaacaccattgcacagctagtccatgctgttaacaactcagcggctcaacacctgttcattcagaccttttggcaaaccatgaatcgagaatggaaaggaatagacaggctacgcctggacaaatactatatgctgattcgtctggtcctgaggcagtcctttgaagtcttgaagcgaaatggctgggaagaaagccggaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattacaattcatttcagttttacaaaaacacaacaccaaacaaaaaaggcg

SEQ ID NO: 321998 - DNA, 231 bp, Homo sapiens
gaagagctcgccaacaccattgcacagctagtccatgctgttaacaactcagcggctcgtaagtcctgttgtttcttctccttccttccaagttttccgacttgctagtttaatgggaaccttgtgccggtattgtgtagatgtcaggggacaagccattcctgtttttaaaagctgtgataaacttagtcattgacttggtgagagggcacagtgtcttggggagaatca

SEQ ID NO: 321999 - DNA, 459 bp, Homo sapiens
aaacaaaaattgcctttctttagctgattcgtctggtcctgaggcagtcctttgaagtcttgaagcgaaatggctgggaagaaaggtcagtaaaccatttgagttagcatgtggtagccttaaaacttaaaaggtagtagagtgtcaagttttctgaacttgtagagtaccaatgagaagctcgatacatcgttacctatagagaattgaaatccagtagaaggcataaaacagttaagtatatatgacagttaacattttatcctgatttaagtgattgcttttttccttgtaaaatgatttcagccttgcattgattgttaggctgtgtaggttctagacggagtatttttgtttctctttgggaagtgggacgtgttggcatactgtcattcacagaagcatgcgtttggttctttagccgaatcaaggttttcttggatgtcctgatgaaggagg

SEQ ID NO: 322000 - DNA, 5089 bp, Homo sapiens
  misc_feature (16)..(16): n is a, c, g, or t
aaatagccagttgtanacccgaggttataaatgaggcagtactataacggtctaaggtagcgaaggctgggtggctggtggctggctgctccgcagcgctcggctggctgcagcggcaccgcgggttgcgcggccggggatgctccagcgggcgcgatggcccccgccatgcagccggccgagatccaatttgcccagcggctggcgtccagcgagaagggcatccgggaccgagcggtgaagaagctgcgccagtacatcagcgtgaagacgcagagggagacaggaggtttcagtcaggaagaacttgaagagctcgccaacaccattgcacagctagtccatgctgttaacaactcagcggctcaacacctgttcattcagaccttttggcaaaccatgaatcgagaatggaaaggaatagacaggctacgcctggacaaatactatatgctgattcgtctggtcctgaggcagtcctttgaagtcttgaagcgaaatggctgggaagaaagccgaatcaaggttttcttggatgtcctgatgaaggaggtcctgtgtcctgagagtcagtctcctaatggagtgagattccacttcattgatatttacctggatgaactctccaaagtcggggggaaggagcttttagcagatcagaatctcaagtttatcgatccattctgcaaaattgctgcaaagacgaaggaccacaccctggtacagaccatagctcggggtgtcttcgaagctatcgtagatcagtctccttttgtgcctgaagagacgatggaggaacagaagacaaaagtgggtgatggtgacctctctgctgaggagatacctgaaaatgaggtatccttgagaagagctgtcagtaaaaagaagacagcactgggcaaaaaccattccagaaaagatggactcagtgatgaaagaggaagagatgactgtggaacctttgaggacacagggccccttctccagtttgactataaggctgttgctgatcgactcctggaaatgaccagcaggaagaacacgccccacttcaacaggaagcgcctctccaaactcatcaagaaattccaagacctttctgaaggaagcagtatatctcaactcagttttgcggaggacatttctgctgatgaagatgaccaaatcctcagtcaaggaaagcataagaagaaaggaaataaacttttagagaaaactaacttggaaaaggagaaaggaagcagagtcttttgtgtagaggaagaggacagtgaaagcagtcttcaaaagagaagaaggaagaagaagaagaagcaccacctgcagcctgaaaatccaggcccagggggtgcagccccgtccctggaacagaaccggggcagggagcccgaggcctctgggccgaaagccctgaaggcacgtgtggccgagccaggtgcagaggccacgtccagcactggggaggagagtggctccgagcatcctccagccgtccccatgcacaataaaaggaaacggccacggaagaagagcccgagggcccacagggaaatgttggaatcagcagtgttgcccccagaggacatgtctcagagtggcccgagtggcagtcatcctcagggacctagagggtccccgacaggtggagcccaactcctaaaaaggaagcggaaacttggagttgtgcccgtcaatggcagtggcctgtccacgccggcctggcctccattgcagcaggaaggccctcccacaggccccgcagagggggcgaacagccacaccacgctgccccagcgcaggaggctgcagaaaaagaaggcagggcccggcagcctggagctctgtggcctgcccagccagaaaacagcaagtttgaaaaagaggaagaaaatgagagtgatgtcaaacttggtggagcacaacggggtgctggagtccgaagctgggcaaccccaggctctgggaagcagtgggacttgcagttccctgaagaagcagaagctgagggcagagagcgactttgtgaagtttgacacccccttcttaccaaagcccctgttcttcagaagagccaagagcagcactgccacccaccctccaggccctgccgtccagctaaacaagacaccatccagctccaagaaagtcacctttgggctgaacagaaacatgactgccgaattcaagaagacagacaagagtatcttggtcagtcccacgggcccttctcgagtggccttcgaccctgaacagaagcccctccacggggtgctgaagacccccaccagctcacctgccagctcacccctggtggccaagaagcccctgaccaccacaccaaggagaaggcccagggctatggatttcttctgaggagcagcagagtcccttgtaaaagactgcttttgtacagaatgcgctataaattatacctttaagaatgtggggccttttttatgattttgtaagttcccataagttgtgtgcacgaggttctgagagtgcccgcaggctgctgcgtcctggcccctctgtagtggctgcgggcgtcttggttgaatcttttgctacaaaccatgtttgcgtttgagctctccaggattttacatttttgggtaacctcagtgattcccattggtgtaggaaatgagaccctctctgaagctgaggagagcacgttgatctgaactttaaatcaatcagtgctgctggcacaatgaaaggtggaactgcacttctgttgagctctcagttctgcggaatttggtactcattaccgtattcgccgtactaagttggtttctgttagtcttaacagtctgttttcttttaaaagcatgtagggcttcattgccatgttctgtgggtgtttggcaggttaccgatggggaagattcttgtcacagaatcagcaataccatagtttttctacatgtgctcagctgggggtgtggacaggtaggggtggggaaagaagaggctctgcgttctgggggctttttcttctcctccccctacccggtttccctccctgttttcctacctctacggcaagcccaaagtgtcttcccgggagcccagcgcagcccccggctcttacccaggaccccgccccgtgctgagccttctgctgaggtccttgcgtggagcacactcattcctccaagcccttgcgctcccgtttctctctctctccgtccacgttccagccgagtcactgcctgcctgaccggctccatggcagctccccatcttccctagaggctgcctgcgcatctggagcctgcgctccggctcagcgacctttcctctcaaatgcggaagcgtgcacttacagttcagaccgttctcctgtaagttcattacaaacacgggcggaaggcactcaggctttcgttggagaaacagaaataaggccttcttttgagcagcgattgctggatcattgatctgtttgaggaagtgtctgacctgggcctgagagctggagaaggtgcagattcaaagtgagcggctcctgaggagagccgccaaggctgctcgccttctccgtggcttccgcagctaccgtctgcacggtgagagggcacgggcacacggttcgggctggcgtgcagctctcccagccagccacgctctgctcaggcctggaagtgaaagccgcctccttcccgttatgccccccatacaggagcctcggtttttcagcaaaacgcggccagtccccttctccactgctgcctcccagcagagggccccaggatctccaaggtcccagctatggctttggacaacgtggcttcggcccctggggttgcagagcttgcattgggtttacctcggtctcattcattcatggagccaagggtggggtttcacctgcgaacatcagactgacttgctggcgtcaagagcagttgactcactgatgaaggccctggtgaggagaaagcactctgttcttcgcctactctgtaatcgttttgtcataatgagccatgaaaaaagtaatgaacttgtgctgttaatcgtcactgtaatgagaagtcttacgtacaacatagctgtggtggctgcgtggtttaatggctgcattagataggatcctcacatcccattcagaaccaaaactgatacagtgaaacaattaaggtgagcaaatagttttaacttttctttttttttttaagtttcattcttcctagaatatttttctaacaatttttatttcagctttaaagatgggtcatatagccaaacgggccatataatccaacattgttgagatgtcttaggacatctaaggcaaaactggcacatttgttctgcagactattgcaggaatgttttttcctagcatttctatattatctgtccattctgaggaaccagtgaatgtcctataaatgcacctcctgtcaaaaccatgcctgagaggtcccggctgggagtgacagggtgcttcttagattctattggtccttctctcattctccgaacttactcctttttatgggtaagtcaactaggtttacagtcccttatttttaatgcctaagttttgacagcaggaagaaaacaattttttaaaaattctcattacatagacgcacaagaatatgtcacataaagaaaatgtgtttagaatactggttttctatttacgcatgatattttcctaagtaaaattgccaagtggacttggaagtccagaaaggaaaataatttaaattaatgctggtgatcttaacaatattttgtaaaatgatgcttcccccttctccatggtctagtcaattttgtacaattaggtatctgactttacaagtttgttatcctttctaatttttactgaactgaaagcacaaagaagactacacagaaaatctggaaacagttgcaggtgttgggaggaagatgaaatcgagctgtcttttaacttttgtatgtgttttatcagaatttgctggactatgctggcaaggactttgtttacgatcaaattgtactagtgtctgcagggtttgtcagtactcgtcaaagccaagtccaattaaaaaaaaaagtctttgccctccaaaaaaaaatt

SEQ ID NO: 322001 - DNA, 3172 bp, Homo sapiens
ccaccctaccagcagctccccttagtctgtgcaggcagccctgggccctcccttgggagggtgagttgaggcatgggatgtggcctcactgccctcctttcctcagaaggctcttgggcctgctctctgcagggccttgagatggccctgcttcgtcctagcaagtgggtggggtcggcacccaggcaggacgctgtctaaggtgttgaagggacagctgtcggacccacttaatatggggccttgctctcatttgggacagaattcaagaagacagacaagagtatcttggtcagtcccacgggcccttctcgagtggccttcgaccctgaacagaagcccctccacggggtgctgaagacccccaccagctcacctgccagctcacccctggtggccaagaagcccctgaccaccacaccaaggagaaggcccagggctatggatttcttctgaggagcagcagagtcccttgtaaaagactgcttttgtacagaatgcgctataaattatacctttaagaatgtggggccttttttatgattttgtaagttcccataagttgtgtgcacgaggttctgagagtgcccgcaggctgctgcgtcctggcccctctgtagtggctgcgggcgtcttggttgaatcttttgctacaaaccatgtttgcgtttgagctctccaggattttacatttttgggtaacctcagtgattcccattggtgtaggaaatgagaccctctctgaagctgaggagagcacgttgatctgaactttaaatcaatcagtgctgctggcacaatgaaaggtggaactgcacttctgttgagctctcagttctgcggaatttggtactcattaccgtattcgccgtactaagttggtttctgttagtcttaacagtctgttttcttttaaaagcatgtagggcttcattgccatgttctgtgggtgtttggcaggttaccgatggggaagattcttgtcacagaatcagcaataccatagtttttctacatgtgctcagctgggggtgtggacaggtaggggtggggaaagaagaggctctgcgttctgggggctttttcttctcctccccctacccggtttccctccctgttttcctacctctacggcaagcccaaagtgtcttcccgggagcccagcgcagcccccggctcttacccaggaccccgccccgtgctgagccttctgctgaggtccttgcgtggagcacactcattcctccaagcccttgcgctcccgtttctctctctctccgtccacgttccagccgagtcactgcctgcctgaccggctccatggcagctccccatcttccctagaggctgcctgcgcatctggagcctgcgctccggctcagcgacctttcctctcaaatgcggaagcgtgcacttacagttcagaccgttctcctgtaagttcattacaaacacgggcggaaggcactcaggctttcgttggagaaacagaaataaggccttcttttgagcagcgattgctggatcattgatctgtttgaggaagtgtctgacctgggcctgagagctggagaaggtgcagattcaaagtgagcggctcctgaggagagccgccaaggctgctcgccttctccgtggcttccgcagctaccgtctgcacggtgagagggcacgggcacacggttcgggctggcgtgcagctctcccagccagccacgctctgctcaggcctggaagtgaaagccgcctccttcccgttatgccccccatacaggagcctcggtttttcagcaaaacgcggccagtccccttctccactgctgcctcccagcagagggccccaggatctccaaggtcccagctatggctttggacaacgtggcttcggcccctggggttgcagagcttgcattgggtttacctcggtctcattcattcatggagccaagggtggggtttcacctgcgaacatcagactgacttgctggcgtcaagagcagttgactcactgatgaaggccctggtgaggagaaagcactctgttcttcgcctactctgtaatcgttttgtcataatgagccatgaaaaaagtaatgaacttgtgctgttaatcgtcactgtaatgagaagtcttacgtacaacatagctgtggtggctgcgtggtttaatggctgcattagataggatcctcacatcccattcagaaccaaaactgatacagtgaaacaattaaggtgagcaaatagttttaacttttctttttttttttaagtttcattcttcctagaatatttttctaacaatttttatttcagctttaaagatgggtcatatagccaaacgggccatataatccaacattgttgagatgtcttaggacatctaaggcaaaactggcacatttgttctgcagactattgcaggaatgttttttcctagcatttctatattatctgtccattctgaggaaccagtgaatgtcctataaatgcacctcctgtcaaaaccatgcctgagaggtcccggctgggagtgacagggtgcttcttagattctattggtccttctctcattctccgaacttactcctttttatgggtaagtcaactaggtttacagtcccttatttttaatgcctaagttttgacagcaggaagaaaacaattttttaaaaattctcattacatagacgcacaagaatatgtcacataaagaaaatgtgtttagaatactggttttctatttacgcatgatattttcctaagtaaaattgccaagtggacttggaagtccagaaaggaaaataatttaaattaatgctggtgatcttaacaatattttgtaaaatgatgcttcccccttctccatggtctagtcaattttgtacaattaggtatctgactttacaagtttgttatcctttctaatttttactgaactgaaagcacaaagaagactacacagaaaatctggaaacagttgcaggtgttgggaggaagatgaaatcgagctgtcttttaacttttgtatgtgttttatcagaatttgctggactatgctggcaaggactttgtttacgatcaaattgtactagtgtctgcagggtttgtcagtactcgtcaaagccaagtccaattaaaaaaaaaagtctttgccctccaaaaaaaaatt

SEQ ID NO: 322002 - DNA, 495 bp, Homo sapiens
gaggcgttttcatcgcccctcttggcatggtgccatgatagcggtcgtgttgtgcgtgaagcctgagctctgccgaatggaagggctgtctgcaagtgcggtgcggaagaccgcgggccgtcgggtgggctggatctgcctggggctctgccttcccctcctgtgtgtgtgggcagcacaggaggctctgtcgtctgacccctcctccgcttctcacccctcgctcacgtagggaagcagtgggacttgcagttccctgaagaagcagaagctgagggcagagagcgactttgtgaagtttgacacccccttcttaccaaagcccctgttcttcagaagagccaagagcagcactgccacccaccctccaggccctgccgtccaggtacgcaccctccccagagtggcacagcacatttcaccacaagggcacagatgggcttgagctgacagtgcttcccatgccgggcctggagccccactgtggccctctga

SEQ ID NO: 322003 - DNA, 84 bp, Homo sapiens
catgaccaagtggtatttattctagatatttaaggcttagcatccaaaaatcaaagtaatccatcacatcaatagacgaaaaaa

SEQ ID NO: 322004 - DNA, 3143 bp, Homo sapiens
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322005 - DNA, 3680 bp, Homo sapiens
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggggtgtcttcatgacaagaacagcgaccaggccacttggctgaccaggttgtgagcagaggattctgtgttcctgtccaaactcagtgctgtttcttagaatccttttattccctgggtctctaatgggaccttaaagaccatctggtatcatcttctcattttgcagaagagaaactgaggcccagaggcggagggcagtctgctcaaggtcacgcagctggtgactggttggggcagaccggacccaggtttcctgactcctggcccaagtctcttcctcctatcctgcgggatcactggggggctctcagggaacagcagcagtgccatagccaggctctctgctgcccagcgctggggtgaggctgccgttgtcagcgtggaccactaaccagcccgtcttctctctctgctcccacccctgccgccctcaccctgcccttgttgtctctgtctctcacgtctctcttctgctgtctctcctacctgtcttctggctctctctgtacccttcctggtgctgccgtgcccccaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322006 - DNA, 3099 bp, Homo sapiens
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322007 - DNA, 3044 bp, Homo sapiens
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322008 - DNA, 2402 bp, Homo sapiens
tctagaggatctctcataggttcgcagtgaggaagtgctgctgatgtcatggaaggtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322009 - DNA, 3798 bp, Homo sapiens
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggtgaggggcaccactgggtgagaggggctccaggtggggtgggcggcttgcggggagtgcccaggtgtgaggcgtggtgctggtaggggagagcttgattctgcctctctcatcccaggggtgtcttcatgacaagaacagcgaccaggccacttggctgaccaggttgtgagcagaggattctgtgttcctgtccaaactcagtgctgtttcttagaatccttttattccctgggtctctaatgggaccttaaagaccatctggtatcatcttctcattttgcagaagagaaactgaggcccagaggcggagggcagtctgctcaaggtcacgcagctggtgactggttggggcagaccggacccaggtttcctgactcctggcccaagtctcttcctcctatcctgcgggatcactggggggctctcagggaacagcagcagtgccatagccaggctctctgctgcccagcgctggggtgaggctgccgttgtcagcgtggaccactaaccagcccgtcttctctctctgctcccacccctgccgccctcaccctgcccttgttgtctctgtctctcacgtctctcttctgctgtctctcctacctgtcttctggctctctctgtacccttcctggtgctgccgtgcccccaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322010 - DNA, 4208 bp, Homo sapiens
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaaggtaagaacccaggctttcaggacaaggggaagagcccgtgtgtgtgtgtgtgtgtgtatgtgtgtacacgcagacacatgtatgggcctccatctcatgtgcgtggtgtaactgtgggttagcacctatgcccacgcctgcggggtgcgtcctgcttcattttgcctgtgtggagggctggaggcagggccaaggctgtggggctgtgcagggcctctcaagtggtacagccgtaatggtccttggggccagttgctccggcagcctgcctccatgcaccccctctttgaacctggtttccccatgaaaactggggaaaggagcaggccagggagagtgacccctgagctgtcactgccccctgtcccaccccacagtgaagatgctcattcggaatctgctgaaaacagagcccacccagagaatgaccatcaccgagtttatgaaccacccttggatcatggctttcactcggaccccttttctctcttctcagcaatcaacaaaggtccctcaaaccccactgcacaccagccgggtcctgaaggaggacaaggagcggtgggaggatgtcaaggtgaggggcaccactgggtgagaggggctccaggtggggtgggcggcttgcggggagtgcccaggtgtgaggcgtggtgctggtaggggagagcttgattctgcctctctcatcccaggggtgtcttcatgacaagaacagcgaccaggccacttggctgaccaggttgtgagcagaggattctgtgttcctgtccaaactcagtgctgtttcttagaatccttttattccctgggtctctaatgggaccttaaagaccatctggtatcatcttctcattttgcagaagagaaactgaggcccagaggcggagggcagtctgctcaaggtcacgcagctggtgactggttggggcagaccggacccaggtttcctgactcctggcccaagtctcttcctcctatcctgcgggatcactggggggctctcagggaacagcagcagtgccatagccaggctctctgctgcccagcgctggggtgaggctgccgttgtcagcgtggaccactaaccagcccgtcttctctctctgctcccacccctgccgccctcaccctgcccttgttgtctctgtctctcacgtctctcttctgctgtctctcctacctgtcttctggctctctctgtacccttcctggtgctgccgtgcccccaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322011 - DNA, 2513 bp, Homo sapiens
accccaccgcaggttgtacttggatggcttcttgtaggtgctcccgttctggggccgcagattctcgccggtcttcagtttttggatgaagaagtcgtacttggaggcccgggctaccaggttctgcatctggaccctgctgtgtgggtatccccccttctactccaaccacggccttgccatctctccgggcatgaagactcgcatccgaatgggccagtatgaatttcccaacccagaatggtcagaagtatcagaggaaggtaagaacccaggctttcaggacaaggggaagagcccgtgtgtgtgtgtgtgtgtgtatgtgtgtacacgcagacacatgtatgggcctccatctcatgtgcgtggtgtaactgtgggttagcacctatgcccacgcctgcggggtgcgtcctgcttcattttgcctgtgtggagggctggaggcagggccaaggctgtggggctgtgcagggcctctcaagtggtacagccgtaatggtccttggggccagttgctccggcagcctgcctccatgcaccccctctttgaacctggtttccccatgaaaactggggaaaggagcaggccagggagagtgacccctgagctgtcactgccccctgtcccaccccacagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322012 - DNA, 1955 bp, Homo sapiens
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322013 - DNA, 2186 bp, Homo sapiens
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322014 - DNA, 1786 bp, Homo sapiens
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggaggagatgaccagtgccttggccacaatgcgcgttgactacgagcagatcaagataaaaaagattgaagatgcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322015 - DNA, 453 bp, Homo sapiens
gtaagctcggcaggctggggagccttgggtctcacgggactattccacaggacagagtcttagccaggaccctaccccaggctttcactcggaccccttttctctcttctcagcaatcaacaaaggtccctcaaaccccactgcacaccagccgggtcctgaaggaggacaaggagcggtgggaggatgtcaaggtgaggggcaccactgggtgagaggggctccaggtggggtgggcggcttgcggggagtgcccaggtgtgaggcgtggtgctggtaggggagagcttgattctgcctctctcatcccaggggtgtcttcatgacaagaacagcgaccaggccacttggctgaccaggttgtgagcagaggattctgtgttcctgtccaaactcagtgctgtttcttagaatccttttattccctgggtctctaatgggaccttaaagacc

SEQ ID NO: 322016 - DNA, 3284 bp, Homo sapiens
  misc_feature (3155)..(3155): n is a, c, g, or t
  misc_feature (3183)..(3183): n is a, c, g, or t
  misc_feature (3197)..(3197): n is a, c, g, or t
  misc_feature (3199)..(3199): n is a, c, g, or t
  misc_feature (3203)..(3203): n is a, c, g, or t
  misc_feature (3205)..(3205): n is a, c, g, or t
  misc_feature (3210)..(3210): n is a, c, g, or t
  misc_feature (3213)..(3213): n is a, c, g, or t
  misc_feature (3234)..(3234): n is a, c, g, or t
  misc_feature (3236)..(3236): n is a, c, g, or t
  misc_feature (3239)..(3240): n is a, c, g, or t
  misc_feature (3247)..(3247): n is a, c, g, or t
  misc_feature (3256)..(3256): n is a, c, g, or t
  misc_feature (3259)..(3259): n is a, c, g, or t
  misc_feature (3276)..(3277): n is a, c, g, or t
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagttaaaaaaaaaaanaaaaaaaaaaaaaaaaaaaaaaaaaaanagggggggggcgcntnttanantattnccnccgggggggccccaagtttgngnggnnacccggntttttggtnaanagagggggcccccaatnngggagag

SEQ ID NO: 322017 - DNA, 3107 bp, Homo sapiens
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccaggccctcccatggtgcggtcgggtcctgagcatttgttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322018 - DNA, 3370 bp, Homo sapiens
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggggtgtcttcatgacaagaacagcgaccaggccacttggctgaccaggttgtgagcagaggattctgtgttcctgtccaaactcagtgctgtttcttagaatccttttattccctgggtctctaatgggaccttaaagaccatctggtatcatgtctctcttctgctgtctctcctacctgtcttctggctctctctgtacccttcctggtgctgccgtgcccccaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322019 - DNA, 2504 bp, Homo sapiens
agctcacaggcctccagttagactatagagagatccccacacaccatggagaaggatgggcctgaagcctggaatgtaaacacttgattttttggggggcagtggagagtggcggcgggctgttgtgttctctggatctcactgtggcttcatttcagtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322020 - DNA, 3520 bp, Homo sapiens
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaaggtaagaacccaggctttcaggacaaggggaagagcccgtgtgtgtgtgtgtgtgtgtatgtgtgtacacgcagacacatgtatgggcctccatctcatgtgcgtggtgtaactgtgggttagcacctatgcccacgcctgcggggtgcgtcctgcttcattttgcctgtgtggagggctggaggcagggccaaggctgtggggctgtgcagggcctctcaagtggtacagccgtaatggtccttggggccagttgctccggcagcctgcctccatgcaccccctctttgaacctggtttccccatgaaaactggggaaaggagcaggccagggagagtgacccctgagctgtcactgccccctgtcccaccccacagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322021 - DNA, 1944 bp, Homo sapiens
  misc_feature (16)..(16): n is a, c, g, or t
  misc_feature (19)..(19): n is a, c, g, or t
  misc_feature (26)..(26): n is a, c, g, or t
tcgcaggctggtacgnccngggtatntggatatcgtcgaccagggcgtcgcggacgcgtgggcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagtt

SEQ ID NO: 322022 - DNA, 2425 bp, Homo sapiens
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccagggcaggcagggctgcagagggagacggccctgctggggcttaggaaccttctcccttcttgggtctgccctgcccatactgagcctgccaaagtgcctgcagcgcctcccttgtctcagatggtgtgtccagcactcgattgttgtaaactgttgttttgtatgagcgaaattgtctttactaaacagatttaatagtt

SEQ ID NO: 322023 - DNA, 1909 bp, Homo sapiens
  misc_feature (1780)..(1780): n is a, c, g, or t
  misc_feature (1808)..(1808): n is a, c, g, or t
  misc_feature (1822)..(1822): n is a, c, g, or t
  misc_feature (1824)..(1824): n is a, c, g, or t
  misc_feature (1828)..(1828): n is a, c, g, or t
  misc_feature (1830)..(1830): n is a, c, g, or t
  misc_feature (1835)..(1835): n is a, c, g, or t
  misc_feature (1838)..(1838): n is a, c, g, or t
  misc_feature (1859)..(1859): n is a, c, g, or t
  misc_feature (1861)..(1861): n is a, c, g, or t
  misc_feature (1864)..(1865): n is a, c, g, or t
  misc_feature (1872)..(1872): n is a, c, g, or t
  misc_feature (1881)..(1881): n is a, c, g, or t
  misc_feature (1884)..(1884): n is a, c, g, or t
  misc_feature (1901)..(1902): n is a, c, g, or t
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaagagaggagtgaccgggcactggcactgcgatcaggaagactggacccccagccccccccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagttaaaaaaaaaaanaaaaaaaaaaaaaaaaaaaaaaaaaaanagggggggggcgcntnttanantattnccnccgggggggccccaagtttgngnggnnacccggntttttggtnaanagagggggcccccaatnngggagag

SEQ ID NO: 322024 - DNA, 1001 bp, Homo sapiens
  misc_feature (872)..(872): n is a, c, g, or t
  misc_feature (900)..(900): n is a, c, g, or t
  misc_feature (914)..(914): n is a, c, g, or t
  misc_feature (916)..(916): n is a, c, g, or t
  misc_feature (920)..(920): n is a, c, g, or t
  misc_feature (922)..(922): n is a, c, g, or t
  misc_feature (927)..(927): n is a, c, g, or t
  misc_feature (930)..(930): n is a, c, g, or t
  misc_feature (951)..(951): n is a, c, g, or t
  misc_feature (953)..(953): n is a, c, g, or t
  misc_feature (956)..(957): n is a, c, g, or t
  misc_feature (964)..(964): n is a, c, g, or t
  misc_feature (973)..(973): n is a, c, g, or t
  misc_feature (976)..(976): n is a, c, g, or t
  misc_feature (993)..(994): n is a, c, g, or t
gatatcacagcaacattgaaatgctaaaaagtttttaaacactctcaatttctaattcaccatgtcacagactggtgaaaaaaaaaaaaaaagcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccggctcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggcccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagttaaaaaaaaaaanaaaaaaaaaaaaaaaaaaaaaaaaaaanagggggggggcgcntnttanantattnccnccgggggggccccaagtttgngnggnnacccggntttttggtnaanagagggggcccccaatnngggagag

SEQ ID NO: 322025 - DNA, 501 bp, Homo sapiens
ggcttggaccaggaacaacatggtctgagagagctcatcccatgttccaaagggagattaaatgacaaattaagataccccaatattaaaacaacaacaataagatcttcctatctggagggtacagaggtgaatggctttggttttcatttctcttcttcactgccttttctcggtgtggtatttgacaagattttagctcaaagcctcaccatgaattgattttttttgtttgtgtgtgtgtttgttttgggacaattttagatacctgagtgcactttttcagttagtcctaacttttaaaagaaggaaaaccaagagacatatctggtgtacgtgttgcagtatgaactctggttgcaatccctccccctcccacactgccccccatttgagtacgccgcacaagtcaaacgctaggaagtttgaataaaaccaatttttctaacttgttgctcatttgttgtaactcaataaagcaaagactaaacatttttataa

SEQ ID NO: 322026 - DNA, 3588 bp, Homo sapiens
cttcaaagacggagcgtcccgttgatcagcacagcagttctaacagacttccctgtctaggcctggccagcctctgcagggacgcagtcggagtctgattcagccagttccgacacaccttctgccgcagcctgactctagctatctgatctatctgagatcgcatcctcctccccgaccgtcacctccacgtattccatcccggggaggccaacttcaagctgaagttaattaaacgcaataatcaaactgtcttggaacagtccatcgaaaccaccaaccatgtcgtgtccatcaccaccagtggccctggaactggtgacagtgattctgggatctcggtgagtaaaacccccatcatgaagcctggaaaaccaaaagcggatgccaagaaggtgcccaagaagcccgaggagatcacccccgagaaccacgtggaagggaccgcccgcctggtgacagacacagctgagatcctctcgagactcggcggggtggagctcctccaagacacattaggacacgtcatgccttctgtacagctgccaccaaatatcaaccttgtgcccaaggtccctgtcccactaaatactaccaaatacaactctgccctggatacaaatgccacgatgatcaactctttcaacaagtttccttacccgacccaggctgagttgtcctggctgacagctgcctccaaacacccagaggagcacatcagaatctggtttgccacccagcgcttaaagcatggcatcagctggtccccagaagaggtggaggaggcccggaagaagatgttcaacggcaccatccagtcagtacccccgaccatcactgtgctgcccgcccagttggcccccacaaaggtgacgcagcccatcctccagacggctctaccgtgccagatcctcggccagactagcctggtgctgactcaggtgaccagcgggtcaacaaccgtctcttgctcccccatcacacttgccgtggcaggagtcaccaaccatggccagaagagacccttggtgactccccaagctgcccccgaacccaagcgtccacacatcgctcaggtgccagagcccccacccaaggtggccaaccccccgctcacaccagccagtgaccgcaagaagacaaaggagcagatagcacatctcaaggccagctttctccagagccagttccctgacgatgccgaggtttaccggctcatcgaggtgactggccttgccaggagcgagatcaagaagtggttcagtgaccaccgatatcggtgtcaaaggggcatcgtccacatcaccagcgaatcccttgccaaagaccagttggccatcgcggcctcccgacacggtcgcacgtatcatgcgtacccagactttgccccccagaagttcaaagagaaaacacagggtcaggttaaaatcttggaagacagctttttgaaaagttcttttcctacccaagcagaactggatcggctaagggtggagaccaagctgagcaggagagagatcgactcctggttctcggagaggcggaagcttcgagacagcatggaacaagctgtcttggattccatggggtctggcaaaaaaggccaagatgtgggagcccccaatggtgctctgtctcgactcgaccagctctccggtgcccagttaacaagttctctgcccagcccttcgccagcaattgcaaaaagtcaagaacaggttcatctcctgaggagcacgtttgcaagaacccagtggcctactccccaggagtacgaccagttagcggccaagactggcctggtccgaactgagattgtgcgttggttcaaggagaacagatgcttgctgaaaacgggaaccgtgaagtggatggagcagtaccagcaccagcccatggcagatgatcacggctacgatgccgtagcaaggaaagcaacaaaacccatggccgagagcccaaagaacgggggtgatgtggttccacaatattacaaggaccccaaaaagctctgcgaagaggacttggagaagttggtgaccagggtaaaagtaggcagcgagccagcaaaagactgtttgccagcaaagccctcagaggccacctcagaccggtcagagggcagcagccgggacggccagggtagcgacgagaacgaggagtcgagcgttgtggattacgtggaggtgacggtcggggaggaggatgcgatctcagatagatcagatagctggagtcaggctgcggcagaaggtgtgtcggaactggctgaatcagactccgactgcgtccctgcagaggctggccaggcctagacagggaagtctgttagaactgctgtgctgatcaacgggacgctccgtctttgaagaaagaagagatggtctctccccagccatgggccacccttgccagtgactccaagtggaactacttagctcgcgtgtgcctggagggtgcgggaagtccagcgactctcagacgcacctcccagaggaccggtgggaattgttcatagtgccaaagtcctactactgcgttttcaatgggtccttgtacatagtttgctcctctgccctagccctcacctcttgctatactggaaccgatttgtacaatgtgggaattttgttacctttttaatcaagggcaacttccttttccagcactaccattgtaaggtttttttcaggagggagggctaaccaccttgcttttctcttttctctttttcttttttttatttttgttttattaatttggggaaaggggtgttagcattagtgccatgatatctactggattttaagtagggagactttatttttaaaggtaggttgaaatttgggagatttctcggcaggaagggctgaaatccaggcccctgtctcaacttggagagaggtgacagacggcagatcttccaaatcaaattcctttccagttcttcccctggctgcctttttgggggtccctgccttagccccacacaaggctttctgaactgccaagaggggatctggcttctcaactgctcggcctcttgggcagggctgtgcccagccagccctgggagaactgggtagcaggtggctgacttctttaagcacctttctaaataccagcagaagaggctcccgcctctgttagcatgatcagtactattgtgacattaaaacaacaacaataagatcttcctatctggagggtacagaggtgaatggctttggttttcatttctcttcttcactgccttttctcggtgtggtatttgacaagattttagctcaaagcctcaccatgaattgattttttttgtttgtgtgtgtgtttgttttgggacaattttagatacctgagtgcactttttcagttagtcctaacttttaaaagaaggaaaaccaagagacatatctggtgtacgtgttgcagtatgaactctggttgcaatccctccccctcccacactgccccccatttgagtacgccgcacaagtcaaacgctaggaagtttgaataaaaccaatttttctaacttgttgctcatttgttgtaactcaataaagcaaagactaaacatttttataa

SEQ ID NO: 322027 - DNA, 3581 bp, Homo sapiens
tagtacccacactaatcatcatcacacgctgaggaaaccaaacagaacgactcaatgcaggactttatttcctattctacaccctagcaggatccctaccactgctggtagcactagtttatatccaaaacaccacaggctcactaaacttcttaattatccatccctatccgaccacaactccaagttccatcccggggaggccaacttcaagctgaagttaattaaacgcaataatcaaactgtcttggaacagtccatcgaaaccaccaaccatgtcgtgtccatcaccaccagtggccctggaactggtgacagtgattctgggatctcggtgagtaaaacccccatcatgaagcctggaaaaccaaaagcggatgccaagaaggtgcccaagaagcccgaggagatcacccccgagaaccacgtggaagggaccgcccgcctggtgacagacacagctgagatcctctcgagactcggcggggtggagctcctccaagacacattaggacacgtcatgccttctgtacagctgccaccaaatatcaaccttgtgcccaaggtccctgtcccactaaatactaccaaatacaactctgccctggatacaaatgccacgatgatcaactctttcaacaagtttccttacccgacccaggctgagttgtcctggctgacagctgcctccaaacacccagaggagcacatcagaatctggtttgccacccagcgcttaaagcatggcatcagctggtccccagaagaggtggaggaggcccggaagaagatgttcaacggcaccatccagtcagtacccccgaccatcactgtgctgcccgcccagttggcccccacaaaggtgacgcagcccatcctccagacggctctaccgtgccagatcctcggccagactagcctggtgctgactcaggtgaccagcgggtcaacaaccgtctcttgctcccccatcacacttgccgtggcaggagtcaccaaccatggccagaagagacccttggtgactccccaagctgcccccgaacccaagcgtccacacatcgctcaggtgccagagcccccacccaaggtggccaaccccccgctcacaccagccagtgaccgcaagaagacaaaggagcagatagcacatctcaaggccagctttctccagagccagttccctgacgatgccgaggtttaccggctcatcgaggtgactggccttgccaggagcgagatcaagaagtggttcagtgaccaccgatatcggtgtcaaaggggcatcgtccacatcaccagcgaatcccttgccaaagaccagttggccatcgcggcctcccgacacggtcgcacgtatcatgcgtacccagactttgccccccagaagttcaaagagaaaacacagggtcaggttaaaatcttggaagacagctttttgaaaagttcttttcctacccaagcagaactggatcggctaagggtggagaccaagctgagcaggagagagatcgactcctggttctcggagaggcggaagcttcgagacagcatggaacaagctgtcttggattccatggggtctggcaaaaaaggccaagatgtgggagcccccaatggtgctctgtctcgactcgaccagctctccggtgcccagttaacaagttctctgcccagcccttcgccagcaattgcaaaaagtcaagaacaggttcatctcctgaggagcacgtttgcaagaacccagtggcctactccccaggagtacgaccagttagcggccaagactggcctggtccgaactgagattgtgcgttggttcaaggagaacagatgcttgctgaaaacgggaaccgtgaagtggatggagcagtaccagcaccagcccatggcagatgatcacggctacgatgccgtagcaaggaaagcaacaaaacccatggccgagagcccaaagaacgggggtgatgtggttccacaatattacaaggaccccaaaaagctctgcgaagaggacttggagaagttggtgaccagggtaaaagtaggcagcgagccagcaaaagactgtttgccagcaaagccctcagaggccacctcagaccggtcagagggcagcagccgggacggccagggtagcgacgagaacgaggagtcgagcgttgtggattacgtggaggtgacggtcggggaggaggatgcgatctcagatagatcagatagctggagtcaggctgcggcagaaggtgtgtcggaactggctgaatcagactccgactgcgtccctgcagaggctggccaggcctagacagggaagtctgttagaactgctgtgctgatcaacgggacgctccgtctttgaagaaagaagagatggtctctccccagccatgggccacccttgccagtgactccaagtggaactacttagctcgcgtgtgcctggagggtgcgggaagtccagcgactctcagacgcacctcccagaggaccggtgggaattgttcatagtgccaaagtcctactactgcgttttcaatgggtccttgtacatagtttgctcctctgccctagccctcacctcttgctatactggaaccgatttgtacaatgtgggaattttgttacctttttaatcaagggcaacttccttttccagcactaccattgtaaggtttttttcaggagggagggctaaccaccttgcttttctcttttctctttttcttttttttatttttgttttattaatttggggaaaggggtgttagcattagtgccatgatatctactggattttaagtagggagactttatttttaaaggtaggttgaaatttgggagatttctcggcaggaagggctgaaatccaggcccctgtctcaacttggagagaggtgacagacggcagatcttccaaatcaaattcctttccagttcttcccctggctgcctttttgggggtccctgccttagccccacacaaggctttctgaactgccaagaggggatctggcttctcaactgctcggcctcttgggcagggctgtgcccagccagccctgggagaactgggtagcaggtggctgacttctttaagcacctttctaaataccagcagaagaggctcccgcctctgttagcatgatcagtactattgtgacattaaaacaacaacaataagatcttcctatctggagggtacagaggtgaatggctttggttttcatttctcttcttcactgccttttctcggtgtggtatttgacaagattttagctcaaagcctcaccatgaattgattttttttgtttgtgtgtgtgtttgttttgggacaattttagatacctgagtgcactttttcagttagtcctaacttttaaaagaaggaaaaccaagagacatatctggtgtacgtgttgcagtatgaactctggttgcaatccctccccctcccacactgccccccatttgagtacgccgcacaagtcaaacgctaggaagtttgaataaaaccaatttttctaacttgttgctcatttgttgtaactcaataaagcaaagactaaacatttttataa

SEQ ID NO: 322028 - DNA, 1753 bp, Homo sapiens
tgctagtgtcatccctgttatacagaagcaaaaactaagccctagagtgatcaagtcctataggtacagccctgcagccactaaggggagaagttaggacccaaatccagatttgtctgactccagggccttttaggagccactgggactggttgactttctaggaataataaaagggtcttgtaaggatgaaaagaatcacaggccaccaccttcacttgcccagaaagtcactctgttttcaaaggcctgattctggaggcttttcctattatggcggactgtgctcagaaaacacactcgtttctttacaacaggccccgtacatgaagggcatgtgtctctcttccaagccccaggatgactttggaaggcccccaccccaacccaggagagccaggaagaagcaaaccatgatgccttccccccagggaacaatggtcatttgcctgacatcttgactctgtggttttgtgtcttctagggaagtctgttagaactgctgtgctgatcaacgggacgctccgtctttgaagaaagaagagatggtctctccccagccatgggccacccttgccagtgactccaagtggaactacttagctcgcgtgtgcctggagggtgcgggaagtccagcgactctcagacgcacctcccagaggaccggtgggaattgttcatagtgccaaagtcctactactgcgttttcaatgggtccttgtacatagtttgctcctctgccctagccctcacctcttgctatactggaaccgatttgtacaatgtgggaattttgttacctttttaatcaagggcaacttccttttccagcactaccattgtaaggtttttttcaggagggagggctaaccaccttgcttttctcttttctctttttcttttttttatttttgttttattaatttggggaaaggggtgttagcattagtgccatgatatctactggattttaagtagggagactttatttttaaaggtaggttgaaatttgggagatttctcggcaggaagggctgaaatccaggcccctgtctcaacttggagagaggtgacagacggcagatcttccaaatcaaattcctttccagttcttcccctggctgcctttttgggggtccctgccttagccccacacaaggctttctgaactgccaagaggggatctggcttctcaactgctcggcctcttgggcagggctgtgcccagccagccctgggagaactgggtagcaggtggctgacttctttaagcacctttctaaataccagcagaagaggctcccgcctctgttagcatgatcagtactattgtgacattaaaacaacaacaataagatcttcctatctggagggtacagaggtgaatggctttggttttcatttctcttcttcactgccttttctcggtgtggtatttgacaagattttagctcaaagcctcaccatgaattgattttttttgtttgtgtgtgtgtttgttttgggacaattttagatacctgagtgcactttttcagttagtcctaacttttaaaagaaggaaaaccaagagacatatctggtgtacgtgttgcagtatgaactctggttgcaatccctccccctcccacactgccccccatttgagtacgccgcacaagtcaaacgctaggaagtttgaataaaaccaatttttctaacttgttgctcatttgttgtaactcaataaagcaaagactaaacatttttataa

SEQ ID NO: 322029 - DNA, 3562 bp, Homo sapiens
cggccgccgcgcggggtcgtgcttaatattcaatgatctcgctcgcgcctccccctcctcttctcgcagaaattccaccgagtccgttactgggctcagacttttaagttaatttactgcccccctaccttggccagtaaccagcgcctttagggctagcctcccccccagctcctgcctgaaaaatgacatttcgccggtgtctccggagggggctgaatttcactttgtaactttctgcggaacccgagcccgggtggcagctcgggtggtggtatcgtatgcaaatacgcatgctgacgttacagatcatgtgggttttggcgtagattccccactgatcgaggcattttttttccctttttttttcctttttttttttcttttaaaaattttggccaccgttctccgtacgggggctttttctgtctgtctgtctggctggcaggctggctttccccctctttcccacggagcccgagccgggcgcccggtggggagtggggagtgggtggggggagccagcagagttccattttggaacgcccgtgccgcgtctccgcgttcccagcccgggtccccgcgttcacagccccagcgcaggtctggatgtaccgactgcttttggaataaaaagattcccaggatgtgagcaacacgggaccgatatgatgcttcctggtgtgtttagtggttggtgccattccaattttctgtgctgaaatcattctgaaaactcaaacagtagacttcagcacacaaggaaagccaaagccatttgagggggaataaagccaaaagcctttcaccttattcgttccaagaatctcaccgccccctccttatccccctccaaaaataagccattgcacacagacaggcagcatggctagcaaacgaaaatctacaactccatgcatggttcggacatcacaagtagtagaacaagatgtgcccgaggaagtagacagggccaaagagaaaggaatcggcacaccacagcctgacgtggccaaggacagttgggcagcagaacttgaaaactcttccaaagaaaacgaagtgatagaggtgaaatctatgggggaaagccagtccaaaaaactccaaggtggttatgagtgcaaatactgcccctactccacgcaaaacctgaacgagttcacggagcatgtcgacatgcagcatcccaacgtgattctcaaccccctctacgtgtgtgcagaatgtaacttcacaaccaaaaagtacgactccctatccgaccacaactccaagttccatcccggggaggccaacttcaagctgaagttaattaaacgcaataatcaaactgtcttggaacagtccatcgaaaccaccaaccatgtcgtgtccatcaccaccagtggccctggaactggtgacagtgattctgggatctcggtgagtaaaacccccatcatgaagcctggaaaaccaaaagcggatgccaagaaggtgcccaagaagcccgaggagatcacccccgagaaccacgtggaagggaccgcccgcctggtgacagacacagctgagatcctctcgagactcggcggggtggagctcctccaagacacattaggacacgtcatgccttctgtacagctgccaccaaatatcaaccttgtgcccaaggtccctgtcccactaaatactaccaaatacaactctgccctggatacaaatgccacgatgatcaactctttcaacaagtttccttacccgacccaggctgagttgtcctggctgacagctgcctccaaacacccagaggagcacatcagaatctggtttgccacccagcgcttaaagcatggcatcagctggtccccagaagaggtggaggaggcccggaagaagatgttcaacggcaccatccagtcagtacccccgaccatcactgtgctgcccgcccagttggcccccacaaaggtgacgcagcccatcctccagacggctctaccgtgccagatcctcggccagactagcctggtgctgactcaggtgaccagcgggtcaacaaccgtctcttgctcccccatcacacttgccgtggcaggagtcaccaaccatggccagaagagacccttggtgactccccaagctgcccccgaacccaagcgtccacacatcgctcaggtgccagagcccccacccaaggtggccaaccccccgctcacaccagccagtgaccgcaagaagacaaaggagcagatagcacatctcaaggccagctttctccagagccagttccctgacgatgccgaggtttaccggctcatcgaggtgactggccttgccaggagcgagatcaagaagtggttcagtgaccaccgatatcggtgtcaaaggggcatcgtccacatcaccagcgaatcccttgccaaagaccagttggccatcgcggcctcccgacacggtcgcacgtatcatgcgtacccagactttgccccccagaagttcaaagagaaaacacagggtcaggttaaaatcttggaagacagctttttgaaaagttcttttcctacccaagcagaactggatcggctaagggtggagaccaagctgagcaggagagagatcgactcctggttctcggagaggcggaagcttcgagacagcatggaacaagctgtcttggattccatggggtctggcaaaaaaggccaagatgtgggagcccccaatggtgctctgtctcgactcgaccagctctccggtgcccagttaacaagttctctgcccagcccttcgccagcaattgcaaaaagtcaagaacaggttcatctcctgaggagcacgtttgcaagaacccagtggcctactccccaggagtacgaccagttagcggccaagactggcctggtccgaactgagattgtgcgttggttcaaggagaacagatgcttgctgaaaacgggaaccgtgaagtggatggagcagtaccagcaccagcccatggcagatgatcacggctacgatgccgtagcaaggaaagcaacaaaacccatggccgagagcccaaagaacgggggtgatgtggttccacaatattacaaggaccccaaaaagctctgcgaagaggacttggagaagttggtgaccagggtaaaagtaggcagcgagccagcaaaagactgtttgccagcaaagccctcagaggccacctcagaccggtcagagggcagcagccgggacggccagggtagcgacgagaacgaggagtcgagcgttgtggattacgtggaggtgacggtcggggaggaggatgcgatctcagatagatcagatagctggagtcaggctgcggcagaaggtgtgtcggaactggctgaatcagactccgactgcgtccctgcagaggctggccaggcctagacaggtaattccacctgctcacccaggcagcaggggagaacgcagcttgctttcttttcgttgccagggttaatatagattgtagggtacagagatgttgacacagatggtggcgtctttttcttgtaattaacaaataagaatgatgtatattgatcacata

SEQ ID NO: 322030 - DNA, 4672 bp, Homo sapiens
cggccgccgcgcggggtcgtgcttaatattcaatgatctcgctcgcgcctccccctcctcttctcgcagaaattccaccgagtccgttactgggctcagacttttaagttaatttactgcccccctaccttggccagtaaccagcgcctttagggctagcctcccccccagctcctgcctgaaaaatgacatttcgccggtgtctccggagggggctgaatttcactttgtaactttctgcggaacccgagcccgggtggcagctcgggtggtggtatcgtatgcaaatacgcatgctgacgttacagatcatgtgggttttggcgtagattccccactgatcgaggcattttttttccctttttttttcctttttttttttcttttaaaaattttggccaccgttctccgtacgggggctttttctgtctgtctgtctggctggcaggctggctttccccctctttcccacggagcccgagccgggcgcccggtggggagtggggagtgggtggggggagccagcagagttccattttggaacgcccgtgccgcgtctccgcgttcccagcccgggtccccgcgttcacagccccagcgcaggtctggatgtaccgactgcttttggaataaaaagattcccaggatgtgagcaacacgggaccgatatgatgcttcctggtgtgtttagtggttggtgccattccaattttctgtgctgaaatcattctgaaaactcaaacagtagacttcagcacacaaggaaagccaaagccatttgagggggaataaagccaaaagcctttcaccttattcgttccaagaatctcaccgccccctccttatccccctccaaaaataagccattgcacacagacaggcagcatggctagcaaacgaaaatctacaactccatgcatggttcggacatcacaagtagtagaacaagatgtgcccgaggaagtagacagggccaaagagaaaggaatcggcacaccacagcctgacgtggccaaggacagttgggcagcagaacttgaaaactcttccaaagaaaacgaagtgatagaggtgaaatctatgggggaaagccagtccaaaaaactccaaggtggttatgagtgcaaatactgcccctactccacgcaaaacctgaacgagttcacggagcatgtcgacatgcagcatcccaacgtgattctcaaccccctctacgtgtgtgcagaatgtaacttcacaaccaaaaagtacgactccctatccgaccacaactccaagttccatcccggggaggccaacttcaagctgaagttaattaaacgcaataatcaaactgtcttggaacagtccatcgaaaccaccaaccatgtcgtgtccatcaccaccagtggccctggaactggtgacagtgattctgggatctcggtgagtaaaacccccatcatgaagcctggaaaaccaaaagcggatgccaagaaggtgcccaagaagcccgaggagatcacccccgagaaccacgtggaagggaccgcccgcctggtgacagacacagctgagatcctctcgagactcggcggggtggagctcctccaagacacattaggacacgtcatgccttctgtacagctgccaccaaatatcaaccttgtgcccaaggtccctgtcccactaaatactaccaaatacaactctgccctggatacaaatgccacgatgatcaactctttcaacaagtttccttacccgacccaggctgagttgtcctggctgacagctgcctccaaacacccagaggagcacatcagaatctggtttgccacccagcgcttaaagcatggcatcagctggtccccagaagaggtggaggaggcccggaagaagatgttcaacggcaccatccagtcagtacccccgaccatcactgtgctgcccgcccagttggcccccacaaaggtgacgcagcccatcctccagacggctctaccgtgccagatcctcggccagactagcctggtgctgactcaggtgaccagcgggtcaacaaccgtctcttgctcccccatcacacttgccgtggcaggagtcaccaaccatggccagaagagacccttggtgactccccaagctgcccccgaacccaagcgtccacacatcgctcaggtgccagagcccccacccaaggtggccaaccccccgctcacaccagccagtgaccgcaagaagacaaaggagcagatagcacatctcaaggccagctttctccagagccagttccctgacgatgccgaggtttaccggctcatcgaggtgactggccttgccaggagcgagatcaagaagtggttcagtgaccaccgatatcggtgtcaaaggggcatcgtccacatcaccagcgaatcccttgccaaagaccagttggccatcgcggcctcccgacacggtcgcacgtatcatgcgtacccagactttgccccccagaagttcaaagagaaaacacagggtcaggttaaaatcttggaagacagctttttgaaaagttcttttcctacccaagcagaactggatcggctaagggtggagaccaagctgagcaggagagagatcgactcctggttctcggagaggcggaagcttcgagacagcatggaacaagctgtcttggattccatggggtctggcaaaaaaggccaagatgtgggagcccccaatggtgctctgtctcgactcgaccagctctccggtgcccagttaacaagttctctgcccagcccttcgccagcaattgcaaaaagtcaagaacaggttcatctcctgaggagcacgtttgcaagaacccagtggcctactccccaggagtacgaccagttagcggccaagactggcctggtccgaactgagattgtgcgttggttcaaggagaacagatgcttgctgaaaacgggaaccgtgaagtggatggagcagtaccagcaccagcccatggcagatgatcacggctacgatgccgtagcaaggaaagcaacaaaacccatggccgagagcccaaagaacgggggtgatgtggttccacaatattacaaggaccccaaaaagctctgcgaagaggacttggagaagttggtgaccagggtaaaagtaggcagcgagccagcaaaagactgtttgccagcaaagccctcagaggccacctcagaccggtcagagggcagcagccgggacggccagggtagcgacgagaacgaggagtcgagcgttgtggattacgtggaggtgacggtcggggaggaggatgcgatctcagatagatcagatagctggagtcaggctgcggcagaaggtgtgtcggaactggctgaatcagactccgactgcgtccctgcagaggctggccaggcctagacagggaagtctgttagaactgctgtgctgatcaacgggacgctccgtctttgaagaaagaagagatggtctctccccagccatgggccacccttgccagtgactccaagtggaactacttagctcgcgtgtgcctggagggtgcgggaagtccagcgactctcagacgcacctcccagaggaccggtgggaattgttcatagtgccaaagtcctactactgcgttttcaatgggtccttgtacatagtttgctcctctgccctagccctcacctcttgctatactggaaccgatttgtacaatgtgggaattttgttacctttttaatcaagggcaacttccttttccagcactaccattgtaaggtttttttcaggagggagggctaaccaccttgcttttctcttttctctttttcttttttttatttttgttttattaatttggggaaaggggtgttagcattagtgccatgatatctactggattttaagtagggagactttatttttaaaggtaggttgaaatttgggagatttctcggcaggaagggctgaaatccaggcccctgtctcaacttggagagaggtgacagacggcagatcttccaaatcaaattcctttccagttcttcccctggctgcctttttgggggtccctgccttagccccacacaaggctttctgaactgccaagaggggatctggcttctcaactgctcggcctcttgggcagggctgtgcccagccagccctgggagaactgggtagcaggtggctgacttctttaagcacctttctaaataccagcagaagaggctcccgcctctgttagcatgatcagtactattgtgacattaaaacaacaacaataagatcttcctatctggagggtacagaggtgaatggctttggttttcatttctcttcttcactgccttttctcggtgtggtatttgacaagattttagctcaaagcctcaccatgaattgattttttttgtttgtgtgtgtgtttgttttgggacaattttagatacctgagtgcactttttcagttagtcctaacttttaaaagaaggaaaaccaagagacatatctggtgtacgtgttgcagtatgaactctggttgcaatccctccccctcccacactgccccccatttgagtacgccgcacaagtcaaacgctaggaagtttgaataaaaccaatttttctaacttgttgctcatttgttgtaactcaataaagcaaagactaaacatttttataa

SEQ ID NO: 322031 - DNA, 3232 bp, Homo sapiens
cgagctcaatcttgtccttgcatattgtacctgtgtaaattgtgtccgaaacccgaggagatcacccccgagaaccacgtggaagggaccgcccgcctggtgacagacacagctgagatcctctcgagactcggcggggtggagctcctccaagacacattaggacacgtcatgccttctgtacagctgccaccaaatatcaaccttgtgcccaaggtccctgtcccactaaatactaccaaatacaactctgccctggatacaaatgccacgatgatcaactctttcaacaagtttccttacccgacccaggctgagttgtcctggctgacagctgcctccaaacacccagaggagcacatcagaatctggtttgccacccagcgcttaaagcatggcatcagctggtccccagaagaggtggaggaggcccggaagaagatgttcaacggcaccatccagtcagtacccccgaccatcactgtgctgcccgcccagttggcccccacaaaggtgacgcagcccatcctccagacggctctaccgtgccagatcctcggccagactagcctggtgctgactcaggtgaccagcgggtcaacaaccgtctcttgctcccccatcacacttgccgtggcaggagtcaccaaccatggccagaagagacccttggtgactccccaagctgcccccgaacccaagcgtccacacatcgctcaggtgccagagcccccacccaaggtggccaaccccccgctcacaccagccagtgaccgcaagaagacaaaggagcagatagcacatctcaaggccagctttctccagagccagttccctgacgatgccgaggtttaccggctcatcgaggtgactggccttgccaggagcgagatcaagaagtggttcagtgaccaccgatatcggtgtcaaaggggcatcgtccacatcaccagcgaatcccttgccaaagaccagttggccatcgcggcctcccgacacggtcgcacgtatcatgcgtacccagactttgccccccagaagttcaaagagaaaacacagggtcaggttaaaatcttggaagacagctttttgaaaagttcttttcctacccaagcagaactggatcggctaagggtggagaccaagctgagcaggagagagatcgactcctggttctcggagaggcggaagcttcgagacagcatggaacaagctgtcttggattccatggggtctggcaaaaaaggccaagatgtgggagcccccaatggtgctctgtctcgactcgaccagctctccggtgcccagttaacaagttctctgcccagcccttcgccagcaattgcaaaaagtcaagaacaggttcatctcctgaggagcacgtttgcaagaacccagtggcctactccccaggagtacgaccagttagcggccaagactggcctggtccgaactgagattgtgcgttggttcaaggagaacagatgcttgctgaaaacgggaaccgtgaagtggatggagcagtaccagcaccagcccatggcagatgatcacggctacgatgccgtagcaaggaaagcaacaaaacccatggccgagagcccaaagaacgggggtgatgtggttccacaatattacaaggaccccaaaaagctctgcgaagaggacttggagaagttggtgaccagggtaaaagtaggcagcgagccagcaaaagactgtttgccagcaaagccctcagaggccacctcagaccggtcagagggcagcagccgggacggccagggtagcgacgagaacgaggagtcgagcgttgtggattacgtggaggtgacggtcggggaggaggatgcgatctcagatagatcagatagctggagtcaggctgcggcagaaggtgtgtcggaactggctgaatcagactccgactgcgtccctgcagaggctggccaggcctagacagggaagtctgttagaactgctgtgctgatcaacgggacgctccgtctttgaagaaagaagagatggtctctccccagccatgggccacccttgccagtgactccaagtggaactacttagctcgcgtgtgcctggagggtgcgggaagtccagcgactctcagacgcacctcccagaggaccggtgggaattgttcatagtgccaaagtcctactactgcgttttcaatgggtccttgtacatagtttgctcctctgccctagccctcacctcttgctatactggaaccgatttgtacaatgtgggaattttgttacctttttaatcaagggcaacttccttttccagcactaccattgtaaggtttttttcaggagggagggctaaccaccttgcttttctcttttctctttttcttttttttatttttgttttattaatttggggaaaggggtgttagcattagtgccatgatatctactggattttaagtagggagactttatttttaaaggtaggttgaaatttgggagatttctcggcaggaagggctgaaatccaggcccctgtctcaacttggagagaggtgacagacggcagatcttccaaatcaaattcctttccagttcttcccctggctgcctttttgggggtccctgccttagccccacacaaggctttctgaactgccaagaggggatctggcttctcaactgctcggcctcttgggcagggctgtgcccagccagccctgggagaactgggtagcaggtggctgacttctttaagcacctttctaaataccagcagaagaggctcccgcctctgttagcatgatcagtactattgtgacattaaaacaacaacaataagatcttcctatctggagggtacagaggtgaatggctttggttttcatttctcttcttcactgccttttctcggtgtggtatttgacaagattttagctcaaagcctcaccatgaattgattttttttgtttgtgtgtgtgtttgttttgggacaattttagatacctgagtgcactttttcagttagtcctaacttttaaaagaaggaaaaccaagagacatatctggtgtacgtgttgcagtatgaactctggttgcaatccctccccctcccacactgccccccatttgagtacgccgcacaagtcaaacgctaggaagtttgaataaaaccaatttttctaacttgttgctcatttgttgtaactcaataaagcaaagactaaacatttttataa

SEQ ID NO: 322032 - DNA, 1453 bp, Homo sapiens
cggccgccgcgcggggtcgtgcttaatattcaatgatctcgctcgcgcctccccctcctcttctcgcagaaattccaccgagtccgttactgggctcagacttttaagttaatttactgcccccctaccttggccagtaaccagcgcctttagggctagcctcccccccagctcctgcctgaaaaatgacatttcgccggtgtctccggagggggctgaatttcactttgtaactttctgcggaacccgagcccgggtggcagctcgggtggtggtatcgtatgcaaatacgcatgctgacgttacagatcatgtgggttttggcgtagattccccactgatcgaggcattttttttccctttttttttcctttttttttttcttttaaaaattttggccaccgttctccgtacgggggctttttctgtctgtctgtctggctggcaggctggctttccccctctttcccacggagcccgagccgggcgcccggtggggagtggggagtgggtggggggagccagcagagttccattttggaacgcccgtgccgcgtctccgcgttcccagcccgggtccccgcgttcacagccccagcgcaggtctggatgtaccgactgcttttggaataaaaagattcccaggatgtgagcaacacgggaccgatatgatgcttcctggtgtgtttagtggttggtgccattccaattttctgtgctgaaatcattctgaaaactcaaacagtagacttcagcacacaaggaaagccaaagccatttgagggggaataaagccaaaagcctttcaccttattcgttccaagaatctcaccgccccctccttatccccctccaaaaataagccattgcacacagacaggcagcatggctagcaaacgaaaatctacaactccatgcatggttcggacatcacaagtagtagaacaagatgtgcccgaggaagtagacagggccaaagagaaaggaatcggcacaccacagcctgacgtggccaaggacagttgggcagcagaacttgaaaactcttccaaagaaaacgaagtgatagaggtgaaatctatgggggaaagccagtccaaaaaactccaaggtggttatgagtgcaaatactgcccctactccacgcaaaacctgaacgagttcacggagcatgtcgacatgcagcatcccaacgtgattctcaaccccctctacgtgtgtgcagaatgtaacttcacaaccaaaaagtacgactccctatccgaccacaactccaagttccatcccggggaggccaacttcaagctgaagttaattaaacgcaataatcaaactgtcttggaacagtccatcgaaaccaccaaccagatgtgtcctctctacatgcgagatggcgtgtctgagccacggaattgcgtggggactttgcctagatcccacgactggtccgtag

SEQ ID NO: 322033 - DNA, 567 bp, Homo sapiens
aggaggaggccccgtcgcggccttcgccgccgccaacggggctgtccctgtagctcccgatggagtttgaggtcgtgaaacctccgccgagctctgccccggcgagacgaggcgcctccgtcgccaagccgcgccgtcgcggggctcccgggagcggcccttagcgaccccgcccgggccccctcaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccaggtaagataggttactatcttaccttttttattagctattggggcttgaggatgccaatttctggagctcggtgaatcctgagactcaacccgtctttatatgtacaaatcttgatataattaaagataaatttgtttttgttgttg

SEQ ID NO: 322034 - DNA, 388 bp, Homo sapiens
aggaggaggccccgtcgcggccttcgccgccgccaacggggctgtccctgtagctcccgatggagtttgaggtcgtgaaacctccgccgagctctgccccggcgagacgaggcgcctccgtcgccaagccgcgccgtcgcggggctcccgggagcggcccttagcgaccccgcccgggccccctcagcttacaaaacactacacagcaaaataatgatctgctagactgctaacccgagcatccagcttccacaatgcctgtgcaggcagctcaatggacagaatttctgtcctgtccaatctgctataatgaatcggcatcgcgggagctggatgccctggaccgcggctgttcaccacctgacgcgagcacctgcctaatgcatcg

SEQ ID NO: 322035 - DNA, 4860 bp, Homo sapiens
aggaggaggccccgtcgcggccttcgccgccgccaacggggctgtccctgtagctcccgatggagtttgaggtcgtgaaacctccgccgagctctgccccggcgagacgaggcgcctccgtcgccaagccgcgccgtcgcggggctcccgggagcggcccttagcgaccccgcccgggccccctcagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttaggtgaagaccatgtgattctggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaatttactttactagggtaacatgttcactttccagaaatgattggaatttggacaacatttaacttaagcttcaagcagctttttatgagtttgtagcaatccggtgcagtaactgagccatttcctattttaaatggcttctatagaaaattaacaactcagttattaaactagcaggatcctacaatgatacatctagtgaaagtagacttagttaacttatttatttctattttatgtttcactgagagaagtttccatctcattccagctgctttatttatctttttcatggaactttgcatggatttctttttctttttttaattttgaagagtggagttagatgttcttaccatagaattttacagggttatatactagcattctttactgcattatatgtaggagtgtggtgcagtgcttttatctgtagcatataatttttttttaattttccatttttcaagagtagtttctgctttgttaatatttatacacaggctacttgttgaagtaattaattaaaaatataaccaagtgcctaagtctttcagctgatgtactagatattaaattctcctaagttatgcagaatcgtttttacaattttgataaattatgcactaatgtaatggcagttttttaaaatgcagatttaagcctgtacattattgaatctgatgacttggcaaaagaatcaggtgctttcagctttcttgagaaaaccctgtatgtagcgtttgcactgactaacaagatggtattgctgggtttttaatttaaactaattaatttggttgttcattgcattatcttggttaaatattgtttattgtt

SEQ ID NO: 322036 - DNA, 5091 bp, Homo sapiens
agccaagtcttgtcagagatttcctctttcaggtggcaaagctgttttcttcacacttgagtctctacaatattgtttggatcagtagtttccaaagttcattaactcctggccatactttattatgttttggggtactggttatccaagggaaacacttttttaaacaacaaaacaaaaaaaccgcccagcagtccaaagtaatttgtgttcctaaaaatggaatatggaaagttaatttgcttgtttgatgtggtcgttgagaaaaatacataaaagctttgatgtttattatgtgagcaaccaatataaatacagtttagttgaaaggaacactattaaggtattgtttccaggcagaatttcagaaatgtaattaattcagcaaataggttttttaaaaaagacatccaaaggttataaaattatttagaagtattttaggtctgaagctgtaatagttgacttaagcaattaactcttcaaaggtgaatgatgaatatgtggttaattcatacttttgtccatttctagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttaggtgaagaccatgtgattctggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaatttactttactagggtaacatgttcactttccagaaatgattggaatttggacaacatttaacttaagcttcaagcagctttttatgagtttgtagcaatccggtgcagtaactgagccatttcctattttaaatggcttctatagaaaattaacaactcagttattaaactagcaggatcctacaatgatacatctagtgaaagtagacttagttaacttatttatttctattttatgtttcactgagagaagtttccatctcattccagctgctttatttatctttttcatggaactttgcatggatttctttttctttttttaattttgaagagtggagttagatgttcttaccatagaattttacagggttatatactagcattctttactgcattatatgtaggagtgtggtgcagtgcttttatctgtagcatataatttttttttaattttccatttttcaagagtagtttctgctttgttaatatttatacacaggctacttgttgaagtaattaattaaaaatataaccaagtgcctaagtctttcagctgatgtactagatattaaattctcctaagttatgcagaatcgtttttacaattttgataaattatgcactaatgtaatggcagttttttaaaatgcagatttaagcctgtacattattgaatctgatgacttggcaaaagaatcaggtgctttcagctttcttgagaaaaccctgtatgtagcgtttgcactgactaacaagatggtattgctgggtttttaatttaaactaattaatttggttgttcattgcattatcttggttaaatattgtttattgtt

SEQ ID NO: 322037 - DNA, 3874 bp, Homo sapiens
agccaagtcttgtcagagatttcctctttcaggtggcaaagctgttttcttcacacttgagtctctacaatattgtttggatcagtagtttccaaagttcattaactcctggccatactttattatgttttggggtactggttatccaagggaaacacttttttaaacaacaaaacaaaaaaaccgcccagcagtccaaagtaatttgtgttcctaaaaatggaatatggaaagttaatttgcttgtttgatgtggtcgttgagaaaaatacataaaagctttgatgtttattatgtgagcaaccaatataaatacagtttagttgaaaggaacactattaaggtattgtttccaggcagaatttcagaaatgtaattaattcagcaaataggttttttaaaaaagacatccaaaggttataaaattatttagaagtattttaggtctgaagctgtaatagttgacttaagcaattaactcttcaaaggtgaatgatgaatatgtggttaattcatacttttgtccatttctagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagaggtaaagaaactgaacctttcggcttcatgcttaatgtatttgttttctgctgctgcatcttggttataccattactgagtgcattttggtgtgcctatctctgatggatgattgattgcttttaaaacttataacagaaataaaattgtaatccca

SEQ ID NO: 322038 - DNA, 5188 bp, Homo sapiens
agccaagtcttgtcagagatttcctctttcaggtggcaaagctgttttcttcacacttgagtctctacaatattgtttggatcagtagtttccaaagttcattaactcctggccatactttattatgttttggggtactggttatccaagggaaacacttttttaaacaacaaaacaaaaaaaccgcccagcagtccaaagtaatttgtgttcctaaaaatggaatatggaaagttaatttgcttgtttgatgtggtcgttgagaaaaatacataaaagctttgatgtttattatgtgagcaaccaatataaatacagtttagttgaaaggaacactattaaggtattgtttccaggcagaatttcagaaatgtaattaattcagcaaataggttttttaaaaaagacatccaaaggttataaaattatttagaagtattttaggtctgaagctgtaatagttgacttaagcaattaactcttcaaaggtgaatgatgaatatgtggttaattcatacttttgtccatttctagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttagggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaatttactttactagggtaacatgttcactttccagaaatgattggaatttggacaacatttaacttaagcttcaagcagctttttatgagtttgtagcaatccggtgcagtaactgagccatttcctattttaaatggcttctatagaaaattaacaactcagttattaaactagcaggatcctacaatgatacatctagtgaaagtagacttagttaacttatttatttctattttatgtttcactgagagaagtttccatctcattccagctgctttatttatctttttcatggaactttgcatggatttctttttctttttttaattttgaagagtggagttagatgttcttaccatagaattttacagggttatatactagcattctttactgcattatatgtaggagtgtggtgcagtgcttttatctgtagcatataatttttttttaattttccatttttcaagagtagtttctgctttgttaatatttatacacaggctacttgttgaagtaattaattaaaaatataaccaagtgcctaagtctttcagctgatgtactagatattaaattctcctaagttatgcagaatcgtttttacaattttgataaattatgcactaatgtaatggcagttttttaaaatgcagatttaagcctgtacattattgaatctgatgacttggcaaaagaatcaggtgctttcagctttcttgagaaaaccctgtatgtagcgtttgcactgactaacaagatggtattgctgggtttttaatttaaactaattaatttggttgttcattgcattatcttggttaaatattgtttattgtt

SEQ ID NO: 322039 - DNA, 5036 bp, Homo sapiens
agccaagtcttgtcagagatttcctctttcaggtggcaaagctgttttcttcacacttgagtctctacaatattgtttggatcagtagtttccaaagttcattaactcctggccatactttattatgttttggggtactggttatccaagggaaacacttttttaaacaacaaaacaaaaaaaccgcccagcagtccaaagtaatttgtgttcctaaaaatggaatatggaaagttaatttgcttgtttgatgtggtcgttgagaaaaatacataaaagctttgatgtttattatgtgagcaaccaatataaatacagtttagttgaaaggaacactattaaggtattgtttccaggcagaatttcagaaatgtaattaattcagcaaataggttttttaaaaaagacatccaaaggttataaaattatttagaagtattttaggtctgaagctgtaatagttgacttaagcaattaactcttcaaaggtgaatgatgaatatgtggttaattcatacttttgtccatttctagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaaggttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttaggtgaagaccatgtgattctggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaatttactttactagggtaacatgttcactttccagaaatgattggaatttggacaacatttaacttaagcttcaagcagctttttatgagtttgtagcaatccggtgcagtaactgagccatttcctattttaaatggcttctatagaaaattaacaactcagttattaaactagcaggatcctacaatgatacatctagtgaaagtagacttagttaacttatttatttctattttatgtttcactgagagaagtttccatctcattccagctgctttatttatctttttcatggaactttgcatggatttctttttctttttttaattttgaagagtggagttagatgttcttaccatagaattttacagggttatatactagcattctttactgcattatatgtaggagtgtggtgcagtgcttttatctgtagcatataatttttttttaattttccatttttcaagagtagtttctgctttgttaatatttatacacaggctacttgttgaagtaattaattaaaaatataaccaagtgcctaagtctttcagctgatgtactagatattaaattctcctaagttatgcagaatcgtttttacaattttgataaattatgcactaatgtaatggcagttttttaaaatgcagatttaagcctgtacattattgaatctgatgacttggcaaaagaatcaggtgctttcagctttcttgagaaaaccctgtatgtagcgtttgcactgactaacaagatggtattgctgggtttttaatttaaactaattaatttggttgttcattgcattatcttggttaaatattgtttattgtt

SEQ ID NO: 322040 - DNA, 1330 bp, Homo sapiens
agccaagtcttgtcagagatttcctctttcaggtggcaaagctgttttcttcacacttgagtctctacaatattgtttggatcagtagtttccaaagttcattaactcctggccatactttattatgttttggggtactggttatccaagggaaacacttttttaaacaacaaaacaaaaaaaccgcccagcagtccaaagtaatttgtgttcctaaaaatggaatatggaaagttaatttgcttgtttgatgtggtcgttgagaaaaatacataaaagctttgatgtttattatgtgagcaaccaatataaatacagtttagttgaaaggaacactattaaggtattgtttccaggcagaatttcagaaatgtaattaattcagcaaataggttttttaaaaaagacatccaaaggttataaaattatttagaagtattttaggtctgaagctgtaatagttgacttaagcaattaactcttcaaaggtgaatgatgaatatgtggttaattcatacttttgtccatttctagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccaggtaagataggttactatcttaccttttttattagctattggggcttgaggatgccaatttctggagctcggtgaatcctgagactcaacccgtctttatatgtacaaatcttgatataattaaagataaatttgtttttgttgttg

SEQ ID NO: 322041 - DNA, 308 bp, Homo sapiens
gggagaccatggggagagggagaccatggggagagggagagggagagggagagcaaaatcagtatttttcttagttacagagtgattatacagaagatgcaacagatactaaacctgatagggatatcgagttagagctttcagcacttgatactgatgaacctgatggacaaagtgaaccaattgaagtaagtgccacaattagataattgagaggctttgtttgattgaaaatttataaaatactttcatactgaaggattaacattttattttcttaggagatcttggacatacagcttggtatc

SEQ ID NO: 322042 - DNA, 313 bp, Homo sapiens
caggaatatgacatctgttacgatgatcacgtgaattagctgtgtaaggtggcagtgaaattcattgccttatttgtcaatgtggcaatgtctgaagtgttttctattagtggtttcagaatataattttattaaaaatttctagtaaggaggacagtcatagacagtgatttctcctttgccctttgttaaattttctctccagtaaaattggttctccacccaagactcctgtaagtaatgtagcagctacctcagctgggccctctaatgttggaacagagctgaattctgtgcctcaaaaatccagccc

SEQ ID NO: 322043 - DNA, 5207 bp, Homo sapiens
agccaagtcttgtcagagatttcctctttcaggtggcaaagctgttttcttcacacttgagtctctacaatattgtttggatcagtagtttccaaagttcattaactcctggccatactttattatgttttggggtactggttatccaagggaaacacttttttaaacaacaaaacaaaaaaaccgcccagcagtccaaagtaatttgtgttcctaaaaatggaatatggaaagttaatttgcttgtttgatgtggtcgttgagaaaaatacataaaagctttgatgtttattatgtgagcaaccaatataaatacagtttagttgaaaggaacactattaaggtattgtttccaggcagaatttcagaaatgtaattaattcagcaaataggttttttaaaaaagacatccaaaggttataaaattatttagaagtattttaggtctgaagctgtaatagttgacttaagcaattaactcttcaaaggtgaatgatgaatatgtggttaattcatacttttgtccatttctagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttaggtgaagaccatgtgattctggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaatttactttactagggtaacatgttcactttccagaaatgattggaatttggacaacatttaacttaagcttcaagcagctttttatgagtttgtagcaatccggtgcagtaactgagccatttcctattttaaatggcttctatagaaaattaacaactcagttattaaactagcaggatcctacaatgatacatctagtgaaagtagacttagttaacttatttatttctattttatgtttcactgagagaagtttccatctcattccagctgctttatttatctttttcatggaactttgcatggatttctttttctttttttaattttgaagagtggagttagatgttcttaccatagaattttacagggttatatactagcattctttactgcattatatgtaggagtgtggtgcagtgcttttatctgtagcatataatttttttttaattttccatttttcaagagtagtttctgctttgttaatatttatacacaggctacttgttgaagtaattaattaaaaatataaccaagtgcctaagtctttcagctgatgtactagatattaaattctcctaagttatgcagaatcgtttttacaattttgataaattatgcactaatgtaatggcagttttttaaaatgcagatttaagcctgtacattattgaatctgatgacttggcaaaagaatcaggtgctttcagctttcttgagaaaaccctgtatgtagcgtttgcactgactaacaagatggtattgctgggtttttaatttaaactaattaatttggttgttcattgcattatcttggttaaatattgtttattgtt

SEQ ID NO: 322044 - DNA, 5153 bp, Homo sapiens
agccaagtcttgtcagagatttcctctttcaggtggcaaagctgttttcttcacacttgagtctctacaatattgtttggatcagtagtttccaaagttcattaactcctggccatactttattatgttttggggtactggttatccaagggaaacacttttttaaacaacaaaacaaaaaaaccgcccagcagtccaaagtaatttgtgttcctaaaaatggaatatggaaagttaatttgcttgtttgatgtggtcgttgagaaaaatacataaaagctttgatgtttattatgtgagcaaccaatataaatacagtttagttgaaaggaacactattaaggtattgtttccaggcagaatttcagaaatgtaattaattcagcaaataggttttttaaaaaagacatccaaaggttataaaattatttagaagtattttaggtctgaagctgtaatagttgacttaagcaattaactcttcaaaggtgaatgatgaatatgtggttaattcatacttttgtccatttctagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttaggtgaagaccatgtgattctggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaatttactttactagggtaacatgttcactttccagaaatgattggaatttggacaacatttaacttaagcttcaagcagctttttatgagtttgtagcaatccggtgcagtaactgagccatttcctattttaaatggcttctatagaaaattaacaactcagttattaaactagcaggatcctacaatgatacatctagtgaaagtagacttagttaacttatttatttctattttatgtttcactgagagaagtttccatctcattccagctgctttatttatctttttcatggaactttgcatggatttctttttctttttttaattttgaagagtggagttagatgttcttaccatagaattttacagggttatatactagcattctttactgcattatatgtaggagtgtggtgcagtgcttttatctgtagcatataatttttttttaattttccatttttcaagagtagtttctgctttgttaatatttatacacaggctacttgttgaagtaattaattaaaaatataaccaagtgcctaagtctttcagctgatgtactagatattaaattctcctaagttatgcagaatcgtttttacaattttgataaattatgcactaatgtaatggcagttttttaaaatgcagatttaagcctgtacattattgaatctgatgacttggcaaaagaatcaggtgctttcagctttcttgagtaatttaaactaattaatttggttgttcattgcattatcttggttaaatattgtttattgtt

SEQ ID NO: 322045 - DNA, 4383 bp, Homo sapiens
aaatgaaagcacattacaagggactcattaggaattgtggcttaatcgttaaatgcagataatgaaaattgacttttattttttattgaaaaaactttagctccctttgtttcccttttcctaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttaggtgaagaccatgtgattctggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaatttactttactagggtaacatgttcactttccagaaatgattggaatttggacaacatttaacttaagcttcaagcagctttttatgagtttgtagcaatccggtgcagtaactgagccatttcctattttaaatggcttctatagaaaattaacaactcagttattaaactagcaggatcctacaatgatacatctagtgaaagtagacttagttaacttatttatttctattttatgtttcactgagagaagtttccatctcattccagctgctttatttatctttttcatggaactttgcatggatttctttttctttttttaattttgaagagtggagttagatgttcttaccatagaattttacagggttatatactagcattctttactgcattatatgtaggagtgtggtgcagtgcttttatctgtagcatataatttttttttaattttccatttttcaagagtagtttctgctttgttaatatttatacacaggctacttgttgaagtaattaattaaaaatataaccaagtgcctaagtctttcagctgatgtactagatattaaattctcctaagttatgcagaatcgtttttacaattttgataaattatgcactaatgtaatggcagttttttaaaatgcagatttaagcctgtacattattgaatctgatgacttggcaaaagaatcaggtgctttcagctttcttgagaaaaccctgtatgtagcgtttgcactgactaacaagatggtattgctgggtttttaatttaaactaattaatttggttgttcattgcattatcttggttaaatattgtttattgtt

SEQ ID NO: 322046 - DNA, 2898 bp, Homo sapiens
ctctaatcagccgggcattagggtcctcgttgacgatggcattgcagcggatttgcttggtgcggtcagcatacctgagggagctgagagtctcctcgtaattgatgtcagcagggctcagcgctgcaatcatggctgtgcgatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttaggtgaagaccatgtgattctggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaatttactttactagggtaacatgttcactttccagaaatgattggaatttggacaacatttaacttaagcttcaagcagctttttatgagtttgtagcaatccggtgcagtaactgagccatttcctattttaaatggcttctatagaaaattaacaactcagttattaaactagcaggatcctacaatgatacatctagtgaaagtagacttagttaacttatttatttctattttatgtttcactgagagaagtttccatctcattccagctgctttatttatctttttcatggaactttgcatggatttctttttctttttttaattttgaagagtggagttagatgttcttaccatagaattttacagggttatatactagcattctttactgcattatatgtaggagtgtggtgcagtgcttttatctgtagcatataatttttttttaattttccatttttcaagagtagtttctgctttgttaatatttatacacaggctacttgttgaagtaattaattaaaaatataaccaagtgcctaagtctttcagctgatgtactagatattaaattctcctaagttatgcagaatcgtttttacaattttgataaattatgcactaatgtaatggcagttttttaaaatgcagatttaagcctgtacattattgaatctgatgacttggcaaaagaatcaggtgctttcagctttcttgagaaaaccctgtatgtagcgtttgcactgactaacaagatggtattgctgggtttttaatttaaactaattaatttggttgttcattgcattatcttggttaaatattgtttattgtt

SEQ ID NO: 322047 - DNA, 3925 bp, Homo sapiens
agccaagtcttgtcagagatttcctctttcaggtggcaaagctgttttcttcacacttgagtctctacaatattgtttggatcagtagtttccaaagttcattaactcctggccatactttattatgttttggggtactggttatccaagggaaacacttttttaaacaacaaaacaaaaaaaccgcccagcagtccaaagtaatttgtgttcctaaaaatggaatatggaaagttaatttgcttgtttgatgtggtcgttgagaaaaatacataaaagctttgatgtttattatgtgagcaaccaatataaatacagtttagttgaaaggaacactattaaggtattgtttccaggcagaatttcagaaatgtaattaattcagcaaataggttttttaaaaaagacatccaaaggttataaaattatttagaagtattttaggtctgaagctgtaatagttgacttaagcaattaactcttcaaaggtgaatgatgaatatgtggttaattcatacttttgtccatttctagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagaggtaaagaaactgaacctttcggcttcatgcttaatgtatttgttttctgctgctgcatcttggttataccattactgagtgcattttggtgtgcctatctctgatggatgattgattgcttttaaaacttataacagaaataaaattgtaatcccagatttcttaaataattctttaactagatcatcgggatttttgtttttttga

SEQ ID NO: 322048 - DNA, 3939 bp, Homo sapiens
agttggggagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaa

SEQ ID NO: 322049 - DNA, 3885 bp, Homo sapiens
agttggggagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctatttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaa

SEQ ID NO: 322050 - DNA, 3886 bp, Homo sapiens
agttggggagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagatgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaa

SEQ ID NO: 322051 - DNA, 4001 bp, Homo sapiens
  misc_feature (3814)..(3814): n is a, c, g, or t
agttggggagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatcgataaacacctttatcgatgccaccttcctggtgtctgggcttccgcagcttcttcttcttgaagtaagcatccgtaagatgttttgggatttttaccttgctgatatcgattttgtgttgaagtnggccatgaccaattttctggtgtgtttcttcgtatgaggaactcgacttgaggaccacgaggtcccagtcacaagtaataagccactagcccgctgcttcaggaaaaccaccctcttgcccctgtggcgtcccgtgaggatgatcagaatggtcccggggtatgctggctagtggcatcgatgaaca

SEQ ID NO: 322052 - DNA, 2194 bp, Homo sapiens
gtgatccgacgtgggcccctccgcagcgatttgaagaccttggggaaccgtcgagggggcgcccaattggaaaacctggagctccagcgggaggaagtcggcacgaccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaa

SEQ ID NO: 322053 - DNA, 994 bp, Homo sapiens
ggaatagctttgcccagatttcgcaattgtgcttcggaaccgagcggttttttagacaatccacctgcgcgaaataaatatgttgtaaaaagagggctttattttaccccccaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaa

SEQ ID NO: 322054 - DNA, 4148 bp, Homo sapiens
  misc_feature (4031)..(4031): n is a, c, g, or t
  misc_feature (4045)..(4045): n is a, c, g, or t
agttggggagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaaaaaaaaaaaaaaaaaaaaaaaaaaaaaaaaaaaaaaaaaaaaaggggggaaaaaaaaccaaaaagggccaaaaagggagaggaagaaaaaanaaaggcccggcggnaaaaaacggcagggcgggggaaaaacccgggcgaaaccaaacttggggggcgtggggggaacaatcccctttttttctcaattgtggtaaatggcctgaaaaa

SEQ ID NO: 322055 - DNA, 670 bp, Homo sapiens
  misc_feature (34)..(34): n is a, c, g, or t
  misc_feature (36)..(36): n is a, c, g, or t
  misc_feature (38)..(38): n is a, c, g, or t
actgttccaaggatccccaatgtctctcctaccntnantttgaactgttcagcgttggagttttgaaaaagcaatcatgtttggtttgtttgtttggttttttgtttttgctggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaagaaggtaacaaaaactgtagaattctaaatatccttgaaagtcagaggtgtgctgtttttctaaaccttcattgccctcctaaatctacacgtggctgccctctagtgggaagagaaagatacattttgtatatgtttgtgtgatagaggtatatgcagtaaagtcacagctttaaaagggtggaaaagttagattctaaagtctatctaaaagacaaaagtcctgtgtggtcaaaattctactttgctgttaaattataattaagtatggtatactgtacagcatatgtaacaaccaggttttctcctgtgtttgaaacattgtgtagcagtttctttggttaagcaccagatgaagtagttggcttctgttcaggtttatgttaatt

SEQ ID NO: 322056 - DNA, 3876 bp, Homo sapiens
gaagggggcgttgcggcaccgcccgacgtcgcgtcctcggcggctgcgcagtgcgcacgtcaaagccgggctcgggccgcaagcggggcgaggggttcggggagcggcgcggcctgggagacacagagccttcaggcgccggggcgggggcacaggcgaagactaaggcggcgccgggccccacagcagcagccgcagcccaagcgagcgcagcagcgcggcggcagccgcgggagcccctgggcagccgtccgcccgcgcagccgccgccgccgcgggagcccgtcgccgggagcaggagcgggcggaagacaacggaggggccgagcgtccgagccactccgcggggaccgaacgagcagcccgaagcggcggcggccgaggacggggacagcgacgacgcggaggcagagaagggaacgcccggcccagccccgtagcacaggcggagtgcagcggaggcccctgccgctgccgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaatctccaataaacatctatgttaaatccaaattcagcatttgctgttagctattcagcatcaggcactcttattgattcatgaggaacattactgctaatctgctgttaagtgaacggtttttcattttacccttttgtttttcagtccaggttggagatcgtagctgctgctgcttgcacactagggcacatgtgggctttctcttgatctttgtgtcatttcagaattcaaagactgtgctacgggagttctgaacatggctgggttcatgaaggcaaatgtatggatgagagtgtggtttaggaaagagggcactgatatcagattagacctatgtgtttgcacccatctttgttggcgatctgagtgcagtgtggcaagtgcacacctggcatccctgcgtcagatcgcgcaccttcaggtcgcgcaccttcgctgaaggaagatgacgcagagctttatctgaaatcagaggggagctatccaaaatgggagtttgggggcagctaaagttgacatgcgaataaattgatactgaaacttagcaacttcttaaaagtgtaaagaagcctcataagatcataaggaaaatgtatatatgcttttcacagctttctagaattttttgacatttgattttcttgagacttgtaaacctggatatgttgaagggtatttgttaattttacttttcaaagatactttaaaacagtagagctagcaatgacaccttgcatttcatttcaacactgcttcaaggtttcttttgtatataattcttagaatgctcatttcttttaaatggtttaatttgtacagcagaggaatgttattgtagtagtatgtaactattacctaatactgagtttttgcaaaaaacaatgaatgctcatatgtaattgaaatacttcagatcacatgaaaatgctgatttaacatttaagtatcacagcattaaaagaaaaagaaagtaaaccagtcctttgtattcagttacctaatggggtgccatcaataagctgcgatacagccctggagctcagtcagccacaccttcctgcatcctattggccttattcattttaaatgagttaatgaatctgccagatctgtgaatgatagagattatgctaaattaatgctgattctttgtgtgtgtgggaaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgcaccacttttttgttactgtgaccacggcagaacaatgtcttctagactatatctatgtaaagttattagaatggtatctgttcattttagtgatatgaagatcacaactaacaactgacaaatcagagtttgccagttcaaattcagcatggctgcagctgattaagaaattgatatgattattctttgctagcctctcttactaatggaattatatactggccagtaaaatgggcctcccaattgctgtttcagcaggttttaaaccttcaggaacaccagttaggaaaatagctccagaaaatatagatatattttatttttattaaaatggcagtctacatcataattggcatttctcaagactgtctttaccagaatctgtgtgaaataaggcaatctagtctccttgaaaaaaaaatctcttggatgtttaggaaggaagacttggccgtgatgtggtgtcctggctttgtggtgtagtgctgtgtgtatggagttagtgtaaaaacatggattacaccaagtggaagaaacgtcttcttgccaagctcattcttagaacttacacatctagaacagcttccactttggcagtgaggtcgtagccttttaggtggaagaagtgagggtgcagcgtgtcagacacaacattcatgttactcttacattggaatctgaaggtagttcagacttcgtgggttttgtttttaagcaaaacaatgtgaaaacatttaagtttgaaatgttgcatttgaagttatgatcatttaatatattcatattaccaagactattatactggaagtggtttttgtgttataaaggtttaattttacataaggcagttacttaatgtgatttttaacccttaaaaaagtggagatgtatacatttgttaacaatgccatgaaagcattttctttctcctaaggaaaagtgaatttcttatcagaatatctggctggccctgtaatttaaattaaaataaaattttggagaaacagca

SEQ ID NO: 322057 - DNA, 3816 bp, Homo sapiens
gaagggggcgttgcggcaccgcccgacgtcgcgtcctcggcggctgcgcagtgcgcacgtcaaagccgggctcgggccgcaagcggggcgaggggttcggggagcggcgcggcctgggagacacagagccttcaggcgccggggcgggggcacaggcgaagactaaggcggcgccgggccccacagcagcagccgcagcccaaccgccgccgccgcgggagcccgtcgccgggagcaggagcgggcggaagacaacggaggggccgagcgtccgagccactccgcggggaccgaacgagcagcccgaagcggcggcggccgaggacggggacagcgacgacgcggaggcagagaagggaacgcccggcccagccccgtagcacaggcggagtgcagcggaggcccctgccgctgccgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaatctccaataaacatctatgttaaatccaaattcagcatttgctgttagctattcagcatcaggcactcttattgattcatgaggaacattactgctaatctgctgttaagtgaacggtttttcattttacccttttgtttttcagtccaggttggagatcgtagctgctgctgcttgcacactagggcacatgtgggctttctcttgatctttgtgtcatttcagaattcaaagactgtgctacgggagttctgaacatggctgggttcatgaaggcaaatgtatggatgagagtgtggtttaggaaagagggcactgatatcagattagacctatgtgtttgcacccatctttgttggcgatctgagtgcagtgtggcaagtgcacacctggcatccctgcgtcagatcgcgcaccttcaggtcgcgcaccttcgctgaaggaagatgacgcagagctttatctgaaatcagaggggagctatccaaaatgggagtttgggggcagctaaagttgacatgcgaataaattgatactgaaacttagcaacttcttaaaagtgtaaagaagcctcataagatcataaggaaaatgtatatatgcttttcacagctttctagaattttttgacatttgattttcttgagacttgtaaacctggatatgttgaagggtatttgttaattttacttttcaaagatactttaaaacagtagagctagcaatgacaccttgcatttcatttcaacactgcttcaaggtttcttttgtatataattcttagaatgctcatttcttttaaatggtttaatttgtacagcagaggaatgttattgtagtagtatgtaactattacctaatactgagtttttgcaaaaaacaatgaatgctcatatgtaattgaaatacttcagatcacatgaaaatgctgatttaacatttaagtatcacagcattaaaagaaaaagaaagtaaaccagtcctttgtattcagttacctaatggggtgccatcaataagctgcgatacagccctggagctcagtcagccacaccttcctgcatcctattggccttattcattttaaatgagttaatgaatctgccagatctgtgaatgatagagattatgctaaattaatgctgattctttgtgtgtgtgggaaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgcaccacttttttgttactgtgaccacggcagaacaatgtcttctagactatatctatgtaaagttattagaatggtatctgttcattttagtgatatgaagatcacaactaacaactgacaaatcagagtttgccagttcaaattcagcatggctgcagctgattaagaaattgatatgattattctttgctagcctctcttactaatggaattatatactggccagtaaaatgggcctcccaattgctgtttcagcaggttttaaaccttcaggaacaccagttaggaaaatagctccagaaaatatagatatattttatttttattaaaatggcagtctacatcataattggcatttctcaagactgtctttaccagaatctgtgtgaaataaggcaatctagtctccttgaaaaaaaaatctcttggatgtttaggaaggaagacttggccgtgatgtggtgtcctggctttgtggtgtagtgctgtgtgtatggagttagtgtaaaaacatggattacaccaagtggaagaaacgtcttcttgccaagctcattcttagaacttacacatctagaacagcttccactttggcagtgaggtcgtagccttttaggtggaagaagtgagggtgcagcgtgtcagacacaacattcatgttactcttacattggaatctgaaggtagttcagacttcgtgggttttgtttttaagcaaaacaatgtgaaaacatttaagtttgaaatgttgcatttgaagttatgatcatttaatatattcatattaccaagactattatactggaagtggtttttgtgttataaaggtttaattttacataaggcagttacttaatgtgatttttaacccttaaaaaagtggagatgtatacatttgttaacaatgccatgaaagcattttctttctcctaaggaaaagtgaatttcttatcagaatatctggctggccctgtaatttaaattaaaataaaattttggagaaacagca

SEQ ID NO: 322058 - DNA, 3054 bp, Homo sapiens
tactccagacaagttgaccgatagcaaggactaacccctataccttctgcataatgtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaatctccaataaacatctatgttaaatccaaattcagcatttgctgttagctattcagcatcaggcactcttattgattcatgaggaacattactgctaatctgctgttaagtgaacggtttttcattttacccttttgtttttcagtccaggttggagatcgtagctgctgctgcttgcacactagggcacatgtgggctttctcttgatctttgtgtcatttcagaattcaaagactgtgctacgggagttctgaacatggctgggttcatgaaggcaaatgtatggatgagagtgtggtttaggaaagagggcactgatatcagattagacctatgtgtttgcacccatctttgttggcgatctgagtgcagtgtggcaagtgcacacctggcatccctgcgtcagatcgcgcaccttcaggtcgcgcaccttcgctgaaggaagatgacgcagagctttatctgaaatcagaggggagctatccaaaatgggagtttgggggcagctaaagttgacatgcgaataaattgatactgaaacttagcaacttcttaaaagtgtaaagaagcctcataagatcataaggaaaatgtatatatgcttttcacagctttctagaattttttgacatttgattttcttgagacttgtaaacctggatatgttgaagggtatttgttaattttacttttcaaagatactttaaaacagtagagctagcaatgacaccttgcatttcatttcaacactgcttcaaggtttcttttgtatataattcttagaatgctcatttcttttaaatggtttaatttgtacagcagaggaatgttattgtagtagtatgtaactattacctaatactgagtttttgcaaaaaacaatgaatgctcatatgtaattgaaatacttcagatcacatgaaaatgctgatttaacatttaagtatcacagcattaaaagaaaaagaaagtaaaccagtcctttgtattcagttacctaatggggtgccatcaataagctgcgatacagccctggagctcagtcagccacaccttcctgcatcctattggccttattcattttaaatgagttaatgaatctgccagatctgtgaatgatagagattatgctaaattaatgctgattctttgtgtgtgtgggaaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgcaccacttttttgttactgtgaccacggcagaacaatgtcttctagactatatctatgtaaagttattagaatggtatctgttcattttagtgatatgaagatcacaactaacaactgacaaatcagagtttgccagttcaaattcagcatggctgcagctgattaagaaattgatatgattattctttgctagcctctcttactaatggaattatatactggccagtaaaatgggcctcccaattgctgtttcagcaggttttaaaccttcaggaacaccagttaggaaaatagctccagaaaatatagatatattttatttttattaaaatggcagtctacatcataattggcatttctcaagactgtctttaccagaatctgtgtgaaataaggcaatctagtctccttgaaaaaaaaatctcttggatgtttaggaaggaagacttggccgtgatgtggtgtcctggctttgtggtgtagtgctgtgtgtatggagttagtgtaaaaacatggattacaccaagtggaagaaacgtcttcttgccaagctcattcttagaacttacacatctagaacagcttccactttggcagtgaggtcgtagccttttaggtggaagaagtgagggtgcagcgtgtcagacacaacattcatgttactcttacattggaatctgaaggtagttcagacttcgtgggttttgtttttaagcaaaacaatgtgaaaacatttaagtttgaaatgttgcatttgaagttatgatcatttaatatattcatattaccaagactattatactggaagtggtttttgtgttataaaggtttaattttacataaggcagttacttaatgtgatttttaacccttaaaaaagtggagatgtatacatttgttaacaatgccatgaaagcattttctttctcctaaggaaaagtgaatttcttatcagaatatctggctggccctgtaatttaaattaaaataaaattttggagaaacagca

SEQ ID NO: 322059 - DNA, 2809 bp, Homo sapiens
tttggcaataaccctgatttatgttctcttatcttttagtttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaatctccaataaacatctatgttaaatccaaattcagcatttgctgttagctattcagcatcaggcactcttattgattcatgaggaacattactgctaatctgctgttaagtgaacggtttttcattttacccttttgtttttcagtccaggttggagatcgtagctgctgctgcttgcacactagggcacatgtgggctttctcttgatctttgtgtcatttcagaattcaaagactgtgctacgggagttctgaacatggctgggttcatgaaggcaaatgtatggatgagagtgtggtttaggaaagagggcactgatatcagattagacctatgtgtttgcacccatctttgttggcgatctgagtgcagtgtggcaagtgcacacctggcatccctgcgtcagatcgcgcaccttcaggtcgcgcaccttcgctgaaggaagatgacgcagagctttatctgaaatcagaggggagctatccaaaatgggagtttgggggcagctaaagttgacatgcgaataaattgatactgaaacttagcaacttcttaaaagtgtaaagaagcctcataagatcataaggaaaatgtatatatgcttttcacagctttctagaattttttgacatttgattttcttgagacttgtaaacctggatatgttgaagggtatttgttaattttacttttcaaagatactttaaaacagtagagctagcaatgacaccttgcatttcatttcaacactgcttcaaggtttcttttgtatataattcttagaatgctcatttcttttaaatggtttaatttgtacagcagaggaatgttattgtagtagtatgtaactattacctaatactgagtttttgcaaaaaacaatgaatgctcatatgtaattgaaatacttcagatcacatgaaaatgctgatttaacatttaagtatcacagcattaaaagaaaaagaaagtaaaccagtcctttgtattcagttacctaatggggtgccatcaataagctgcgatacagccctggagctcagtcagccacaccttcctgcatcctattggccttattcattttaaatgagttaatgaatctgccagatctgtgaatgatagagattatgctaaattaatgctgattctttgtgtgtgtgggaaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgcaccacttttttgttactgtgaccacggcagaacaatgtcttctagactatatctatgtaaagttattagaatggtatctgttcattttagtgatatgaagatcacaactaacaactgacaaatcagagtttgccagttcaaattcagcatggctgcagctgattaagaaattgatatgattattctttgctagcctctcttactaatggaattatatactggccagtaaaatgggcctcccaattgctgtttcagcaggttttaaaccttcaggaacaccagttaggaaaatagctccagaaaatatagatatattttatttttattaaaatggcagtctacatcataattggcatttctcaagactgtctttaccagaatctgtgtgaaataaggcaatctagtctccttgaaaaaaaaatctcttggatgtttaggaaggaagacttggccgtgatgtggtgtcctggctttgtggtgtagtgctgtgtgtatggagttagtgtaaaaacatggattacaccaagtggaagaaacgtcttcttgccaagctcattcttagaacttacacatctagaacagcttccactttggcagtgaggtcgtagccttttaggtggaagaagtgagggtgcagcgtgtcagacacaacattcatgttactcttacattggaatctgaaggtagttcagacttcgtgggttttgtttttaagcaaaacaatgtgaaaacatttaagtttgaaatgttgcatttgaagttatgatcatttaatatattcatattaccaagactattatactggaagtggtttttgtgttataaaggtttaattttacataaggcagttacttaatgtgatttttaacccttaaaaaagtggagatgtatacatttgttaacaatgccatgaaagcattttctttctcctaaggaaaagtgaatttcttatcagaatatctggctggccctgtaatttaaattaaaataaaattttggagaaacagca

SEQ ID NO: 322060 - DNA, 1652 bp, Homo sapiens
ggaggcgtctagagatcccttcgagggtcggatgaatagattttacgtgtcatttgttattttcttaccaagtgcatagatatgtgaagtagaatgaatagcagaggaatgttattgtagtagtatgtaactattacctaatactgagtttttgcaaaaaacaatgaatgctcatatgtaattgaaatacttcagatcacatgaaaatgctgatttaacatttaagtatcacagcattaaaagaaaaagaaagtaaaccagtcctttgtattcagttacctaatggggtgccatcaataagctgcgatacagccctggagctcagtcagccacaccttcctgcatcctattggccttattcattttaaatgagttaatgaatctgccagatctgtgaatgatagagattatgctaaattaatgctgattctttgtgtgtgtgggaaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgcaccacttttttgttactgtgaccacggcagaacaatgtcttctagactatatctatgtaaagttattagaatggtatctgttcattttagtgatatgaagatcacaactaacaactgacaaatcagagtttgccagttcaaattcagcatggctgcagctgattaagaaattgatatgattattctttgctagcctctcttactaatggaattatatactggccagtaaaatgggcctcccaattgctgtttcagcaggttttaaaccttcaggaacaccagttaggaaaatagctccagaaaatatagatatattttatttttattaaaatggcagtctacatcataattggcatttctcaagactgtctttaccagaatctgtgtgaaataaggcaatctagtctccttgaaaaaaaaatctcttggatgtttaggaaggaagacttggccgtgatgtggtgtcctggctttgtggtgtagtgctgtgtgtatggagttagtgtaaaaacatggattacaccaagtggaagaaacgtcttcttgccaagctcattcttagaacttacacatctagaacagcttccactttggcagtgaggtcgtagccttttaggtggaagaagtgagggtgcagcgtgtcagacacaacattcatgttactcttacattggaatctgaaggtagttcagacttcgtgggttttgtttttaagcaaaacaatgtgaaaacatttaagtttgaaatgttgcatttgaagttatgatcatttaatatattcatattaccaagactattatactggaagtggtttttgtgttataaaggtttaattttacataaggcagttacttaatgtgatttttaacccttaaaaaagtggagatgtatacatttgttaacaatgccatgaaagcattttctttctcctaaggaaaagtgaatttcttatcagaatatctggctggccctgtaatttaaattaaaataaaattttggagaaacagca

SEQ ID NO: 322061 - DNA, 1927 bp, Homo sapiens
gaagggggcgttgcggcaccgcccgacgtcgcgtcctcggcggctgcgcagtgcgcacgtcaaagccgggctcgggccgcaagcggggcgaggggttcggggagcggcgcggcctgggagacacagagccttcaggcgccggggcgggggcacaggcgaagactaaggcggcgccgggccccacagcagcagccgcagcccaagcgagcgcagcagcgcggcggcagccgcgggagcccctgggcagccgtccgcccgcgcagccgccgccgccgcgggagcccgtcgccgggagcaggagcgggcggaagacaacggaggggccgagcgtccgagccactccgcggggaccgaacgagcagcccgaagcggcggcggccgaggacggggacagcgacgacgcggaggcagagaagggaacgcccggcccagccccgtagcacaggcggagtgcagcggaggcccctgccgctgccgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaagtttgccagttcaaattcagcatggctgcagctgattaagaaattgatatgattattctttgctagcctctcttactaatggaattatatactggccagtaaaatgggcctcccaattgctgtttcagcaggttttaaaccttcaggaacaccagttaggaaaatagctccagaaaatatagatatattttatttttattaaaatggcagtctacatcataattggcatttctcaagactgtctttaccagaatctgtgtgaaataaggcaatctagtctccttgaaaaaaaaatctcttggatgtttaggaaggaagacttggccgtgatgtggtgtcctggctttgtggtgtagtgctgtgtgtatggagttagtgtaaaaacatggattacaccaagtggaagaaacgtcttcttgccaagctcattcttagaacttacacatctagaacagcttccactttggcagtgaggtcgtagccttttaggtggaagaagtgagggtgcagcgtgtcagacacaacattcatgttactcttacattggaatctgaaggtagttcagacttcgtgggttttgtttttaagcaaaacaatgtgaaaacatttaagtttgaaatgttgcatttgaagttatgatcatttaatatattcatattaccaagactattatactggaagtggtttttgtgttataaaggtttaattttacataaggcagttacttaatgtgatttttaacccttaaaaaagtggagatgtatacatttgttaacaatgccatgaaagcattttctttctcctaaggaaaagtgaatttcttatcagaatatctggctggccctgtaatttaaattaaaataaaattttggagaaacagca

SEQ ID NO: 322062 - DNA, 2159 bp, Homo sapiens
gaagggggcgttgcggcaccgcccgacgtcgcgtcctcggcggctgcgcagtgcgcacgtcaaagccgggctcgggccgcaagcggggcgaggggttcggggagcggcgcggcctgggagacacagagccttcaggcgccggggcgggggcacaggcgaagactaaggcggcgccgggccccacagcagcagccgcagcccaagcgagcgcagcagcgcggcggcagccgcgggagcccctgggcagccgtccgcccgcgcagccgccgccgccgcgggagcccgtcgccgggagcaggagcgggcggaagacaacggaggggccgagcgtccgagccactccgcggggaccgaacgagcagcccgaagcggcggcggccgaggacggggacagcgacgacgcggaggcagagaagggaacgcccggcccagccccgtagcacaggcggagtgcagcggaggcccctgccgctgccgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaatctccaataaacatctatgttaaatccaaattcagcatttgctgttagctattcagcatcaggcactcttattgattcatgaggaacattactgctaatctgctgttaagtgaacggtttttcattttacccttttgtttttcagtccaggttggagatcgtagctgctgctgcttgcacactagggcacatgtgggctttctcttgatctttgtgtcatttcagaattcaaagactgtgctacgggagttctgaacatggctgggttcatgaaggcaaatgtatggatgagagtgtggtttaggaaagagggcactgatatcagattagacctatgtgtttgcacccatctttgttggcgatctgagtgcagtgtggcaagtgcacacctggcatccctgcgtcagatcgcgcaccttcaggtcgcgcaccttcgctgaaggaagatgacgcagagctttatctgaaatcagaggggagctatccaaaatgggagtttgggggcagctaaagttgacatgcgaataaattgatactgaaaaacaaaagggtaaaatgaaaaaccgttcacttaacagcagattagcagtaatgttcctcatgaatcaataagagtgcctgatgctgtatagctaacagcaaatgctgaatttt

SEQ ID NO: 322063 - DNA, 1113 bp, Homo sapiens
gaagggggcgttgcggcaccgcccgacgtcgcgtcctcggcggctgcgcagtgcgcacgtcaaagccgggctcgggccgcaagcggggcgaggggttcggggagcggcgcggcctgggagacacagagccttcaggcgccggggcgggggcacaggcgaagactaaggcggcgccgggccccacagcagcagccgcagcccaagcgagcgcagcagcgcggcggcagccgcgggagcccctgggcagccgtccgcccgcgcagccgccgccgccgcgggagcccgtcgccgggagcaggagcgggcggaagacaacggaggggccgagcgtccgagccactccgcggggaccgaacgagcagcccgaagcggcggcggccgaggacggggacagcgacgacgcggaggcagagaagggaacgcccggcccagccccgtagcacaggcggagtgcagcggaggcccctgccgctgccgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagtcaggtgacagctacgaacatgacgacatattcgcgttcgagtatacctcctgaaacacccctcacacacatcaagcccgaatagatatgttcctattcgctcacacaattatccgatccgtcccttctgactaggtgg

SEQ ID NO: 322064 - DNA, 2908 bp, Homo sapiens
tggccagaggggacgggagcccggctctgctcctgctctactgctcactcctttgtggccatggccaaggcagttaaccgcttggggacttagaagtccgtccttattgtaaaatgaggacattggactagcttgtcgtttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaatctccaataaacatctatgttaaatccaaattcagcatttgctgttagctattcagcatcaggcactcttattgattcatgaggaacattactgctaatctgctgttaagtgaacggtttttcattttacccttttgtttttcagtccaggttggagatcgtagctgctgctgcttgcacactagggcacatgtgggctttctcttgatctttgtgtcatttcagaattcaaagactgtgctacgggagttctgaacatggctgggttcatgaaggcaaatgtatggatgagagtgtggtttaggaaagagggcactgatatcagattagacctatgtgtttgcacccatctttgttggcgatctgagtgcagtgtggcaagtgcacacctggcatccctgcgtcagatcgcgcaccttcaggtcgcgcaccttcgctgaaggaagatgacgcagagctttatctgaaatcagaggggagctatccaaaatgggagtttgggggcagctaaagttgacatgcgaataaattgatactgaaacttagcaacttcttaaaagtgtaaagaagcctcataagatcataaggaaaatgtatatatgcttttcacagctttctagaattttttgacatttgattttcttgagacttgtaaacctggatatgttgaagggtatttgttaattttacttttcaaagatactttaaaacagtagagctagcaatgacaccttgcatttcatttcaacactgcttcaaggtttcttttgtatataattcttagaatgctcatttcttttaaatggtttaatttgtacagcagaggaatgttattgtagtagtatgtaactattacctaatactgagtttttgcaaaaaacaatgaatgctcatatgtaattgaaatacttcagatcacatgaaaatgctgatttaacatttaagtatcacagcattaaaagaaaaagaaagtaaaccagtcctttgtattcagttacctaatggggtgccatcaataagctgcgatacagccctggagctcagtcagccacaccttcctgcatcctattggccttattcattttaaatgagttaatgaatctgccagatctgtgaatgatagagattatgctaaattaatgctgattctttgtgtgtgtgggaaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgcaccacttttttgttactgtgaccacggcagaacaatgtcttctagactatatctatgtaaagttattagaatggtatctgttcattttagtgatatgaagatcacaactaacaactgacaaatcagagtttgccagttcaaattcagcatggctgcagctgattaagaaattgatatgattattctttgctagcctctcttactaatggaattatatactggccagtaaaatgggcctcccaattgctgtttcagcaggttttaaaccttcaggaacaccagttaggaaaatagctccagaaaatatagatatattttatttttattaaaatggcagtctacatcataattggcatttctcaagactgtctttaccagaatctgtgtgaaataaggcaatctagtctccttgaaaaaaaaatctcttggatgtttaggaaggaagacttggccgtgatgtggtgtcctggctttgtggtgtagtgctgtgtgtatggagttagtgtaaaaacatggattacaccaagtggaagaaacgtcttcttgccaagctcattcttagaacttacacatctagaacagcttccactttggcagtgaggtcgtagccttttaggtggaagaagtgagggtgcagcgtgtcagacacaacattcatgttactcttacattggaatctgaaggtagttcagacttcgtgggttttgtttttaagcaaaacaatgtgaaaacatttaagtttgaaatgttgcatttgaagttatgatcatttaatatattcatattaccaagactattatactggaagtggtttttgtgttataaaggtttaattttacataaggcagttacttaatgtgatttttaacccttaaaaaagtggagatgtatacatttgttaacaatgccatgaaagcattttctttctcctaaggaaaagtgaatttcttatcagaatatctggctggccctgtaatttaaattaaaataaaattttggagaaacagca

SEQ ID NO: 322065 - DNA, 2478 bp, Homo sapiens
gaagggggcgttgcggcaccgcccgacgtcgcgtcctcggcggctgcgcagtgcgcacgtcaaagccgggctcgggccgcaagcggggcgaggggttcggggagcggcgcggcctgggagacacagagccttcaggcgccggggcgggggcacaggcgaagactaaggcggcgccgggccccacagcagcagccgcagcccaagcgagcgcagcagcgcggcggcagccgcgggagcccctgggcagccgtccgcccgcgcagccgccgccgccgcgggagcccgtcgccgggagcaggagcgggcggaagacaacggaggggccgagcgtccgagccactccgcggggaccgaacgagcagcccgaagcggcggcggccgaggacggggacagcgacgacgcggaggcagagaagggaacgcccggcccagccccgtagcacaggcggagtgcagcggaggcccctgccgctgccgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaatctccaataaacatctatgttaaatccaaattcagcatttgctgttagctattcagcatcaggcactcttattgattcatgaggaacattactgctaatctgctgttaagtgaacggtttttcattttacccttttgtttttcagtccaggttggagatcgtagctgctgctgcttgcacactagggcacatgtgggctttctcttgatctttgtgtcatttcagaattcaaagactgtgctacgggagttctgaacatggctgggttcatgaaggcaaatgtatggatgagagtgtggtttaggaaagagggcactgatatcagattagacctatgtgtttgcacccatctttgttggcgatctgagtgcagtgtggcaagtgcacacctggcatccctgcgtcagatcgcgcaccttcaggtcgcgcaccttcgctgaaggaagatgacgcagagctttatctgaaatcagaggggagctatccaaaatgggagtttgggggcagctaaagttgacatgcgaataaattgatactgaaacttagcaacttcttaaaagtgtaaagaagcctcataagatcataaggaaaatgtatatatgcttttcacagctttctagaattttttgacatttgattttcttgagacttgtaaacctggatatgttgaagggtatttgttaattttacttttcaaagatactttaaaacagtagagctagcaatgacaccttgcatttcatttcaacactgcttcaaggtttcttttgtatataattcttagaatgctcatttcttttaaatggtttaatttgtacagcagaggaatgttattgtagtagtatgtaactattacctaatactgagtttttgcaaaaaacaatgaatgctcatatgtaattgaaatacttcagatcacatgaaaatgctgatttaacatttaagtatcacagcattaaaagaaaaagaaagt

SEQ ID NO: 322066 - DNA, 1924 bp, Homo sapiens
gaagggggcgttgcggcaccgcccgacgtcgcgtcctcggcggctgcgcagtgcgcacgtcaaagccgggctcgggccgcaagcggggcgaggggttcggggagcggcgcggcctgggagacacagagccttcaggcgccggggcgggggcacaggcgaagactaaggcggcgccgggccccacagcagcagccgcagcccaagcgagcgcagcagcgcggcggcagccgcgggagcccctgggcagccgtccgcccgcgcagccgccgccgccgcgggagcccgtcgccgggagcaggagcgggcggaagacaacggaggggccgagcgtccgagccactccgcggggaccgaacgagcagcccgaagcggcggcggccgaggacggggacagcgacgacgcggaggcagagaagggaacgcccggcccagccccgtagcacaggcggagtgcagcggaggcccctgccgctgccgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaatctccaataaacatctatgttaaatccaaattcagcatttgctgttagctattcagcatcaggcactcttattgattcatgaggaacattactgctaatctgctgttaagtgaacggtttttcattttacccttttgtttttcagtccaggttggagatcgtagctgctgctgcttgcacactagggcacatgtgggctttctctggaactggggtgcagtcaggaattcacgaagtggctccgcgggtcagcaacaatgggggtggtctgacaggcacagatggcgcgacaatggtgtttcaaaaagcacggatttaataccactggtggaccactgtgttgcacaaaaggggagaccacgacactctatacacagagaccacgagtaagaaactaaatacacagaggaaagacaata

SEQ ID NO: 322067 - DNA, 231 bp, Homo sapiens
taatcttgttatttcattgagttgtaagagttcttgatatgttctggataacactcatcagatatgtagtttgcaaatattttttcccagaaaatatttttatttttttagtcatgcctttggaagtataaaagttttgtttttttttttttttgagactgagtctcactcttgtcacccaggttggagcagtggcacaatctcggctcactgcaatctctgcctcccggg

SEQ ID NO: 322068 - DNA, 2105 bp, Homo sapiens
ccccgcccccacttctaggcttggttgaaccgtgcagataccttctcgaaacaaaagattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggatctccctaatactatgaacgcggcagagataacggacaagctcggcctccattccctccgctacagaaactggcacattcaggctacttgtgccactactggacatgggctttacgaaggcctgaactggctcgccaaccagttccagaaccagaactgatcagaaggatctattctttgtgccttgtggccacatcagctagcctctgctgtgtgcacgtgtacgtgtgtgctgggagtggaggcagctttctcacagtgccttatccatgccataagaaaagcagtgttacattttaagaaacccagtgttaagttttaaacaccaccttccatttcagtagctttgatgatcatttttgcaattgatggagaagtccagagggcttgctggtgctcgaaggccagagcgggcttcatggaggcgagttggagcggggactgagttcagctgttgcaatcctggtctggcgtctggagtcctgttagtctttggcatcctttcgtaaaaaggaaggaattgtcattcttttttttttaaaaccatatttttactgtaccttttcatgtttatttattttttattaaaaaaattttttttgaaacagcctcccactctgtcgcccaagctggagtgcagtggtgcgatctcagctcactgcaacctccgtctctcgggctcaagcaatcctcccacctcagccccctgagtagctgagactatgggtgtgcaccaccacacctggctaatttttgtattttttgtggagacagggtcttgccatgttgcccaggctggtctgtaactcctgagctcaagggatccacccacctcagccttccaaaatgctgggattacaggcatgagccactgcgctaccgagaaatcgtcattctttaccaccactgctgcagctagcagctcactcttcagtgctttaagcaaatgatcctcaggaaagaaaaggtatttgcttattgcaggtgcaaagaggctcagattggaacttttccctgaaactatattgtagcccagagttcctgatgtaagacgctttatttaaagacatccgtgagctttttcactggcatatcaatacttcataacactaggaaggtatccagccttttccttatgctagttccttcccttatttgccagatggggaccctgtggggaggtgacccagtgtgaggccgaagctctttcccagagccccacaggccagtggagggtcgtgtttgtgctctgggcatcaccgtcttgggtctcggtcccctgcgactgcagctgctacatccctccctgctctgagataaatgttcttcccatgaagcagacggttcacttttgggatggcgctgtctccaggtttggctgtctcagtccagatgatgtttggttagtttccattcccagaaccacaagcctttgagttctgaaagtttgtgacagaatcaagaggctaatttgggagatgtgagattcccagcccacctggtattgccctcgagttagtggtaaattttgctatggaaaatatctcttgtcaagaccaagctccggcgcattgcctccctcttttggatggccatggcatctcatgaaccacttggaaatgtgttttatgttgttctccaaatattaataaaaatatcccggagaggaggttcact

SEQ ID NO: 322069 - DNA, 938 bp, Homo sapiens
gctcctgagtagctgggattacaggcgccctccaccacgcccggcgaatttttgtatctttagtagagacagggtttcaccacgttggccaggttggtcttgaactcctgacctcatgatccgcctgcctcggcctcccaaagtgttgggattacaggtgtgagccaccgcacccggcctctgagaaatatttagattgtacgcctcaaatgggcagggactgtgtcttacacttttgtatttatgctacagcttacctaatacagtgccaggcctcgttaaacacttattgattgctcagacgataaagaacttgctttggaaggaggagaggatagtcatgtgcttctgaatgtattgaacttcttgaaatctctttcctcatcaattttagcagagtttctattgaaactcctagggtgtgtttatggaagacaaactgagatgtgctgtcccagccttaggccctggcagtacgccttgccttttcacggcacacccactacagcctttcccacactgtgacactggagctggtgagtcagatgcatggcatgggaagccctctctaggaggatgctgtggccacacaagcgctggacgaaccgctggagttgaagattattctctcttctaaagaaaatagaagaatattaggagaaaagacacttgaaaatgttcactcttttattcacattacatcatctgtcttgaataatgggtctatctctttcctgttgctctggccctgaaaaaaaaattagctttttaaggctgcttttgttacgtgtgcattttcttgtaatcctgtcattctgggatttaataataatagtattaataccacctaccatttgttggttacttactgtgttttaggcactgtgctaaacgccttccatgtattcatctcattagtaaacatttctgaaactatt

SEQ ID NO: 322070 - DNA, 751 bp, Homo sapiens
ccccgcccccacttctaggcttggttgaaccgtgcagataccttctcgaaacaaaagattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggttgaagattattctctcttctaaagaaaatagaagaatattaggagaaaagacacttgaaaatgttcactcttttattcacattacatcatctgtcttgaataatgggtctatctctttcctgttgctctggccctgaaaaaaaaattagctttttaaggctgcttttgttacgtgtgcattttcttgtaatcctgtcattctgggatttaataataatagtattaataccacctaccatttgttggttacttactgtgttttaggcactgtgctaaacgccttccatgtattcatctcattagtaaacatttctgaaactatt

SEQ ID NO: 322071 - DNA, 871 bp, Homo sapiens
gctcctgagtagctgggattacaggcgccctccaccacgcccggcgaatttttgtatctttagtagagacagggtttcaccacgttggccaggttggtcttgaactcctgacctcatgatccgcctgcctcggcctcccaaagtgttgggattacaggtgtgagccaccgcacccggcctctgagaaatatttagattgtacgcctcaaatgggcagggactgtgtcttacacttttgtatttatgctacagcttacctaatacagtgccaggcctcgttaaacacttattgattgctcagacgataaagaacttgctttggaaggaggagaggatagtcatgtgcttctgaatgtattgaacttcttgaaatctctttcctcatcaattttagcagagtttctattgaaactcctagggtgtgtttatggaagacaaactgagatgtgctgtcccagccttaggccctggcagtacgccttgccttttcacggcacacccactacagcctttcccacactgtgacactggagctggtgagtcagagttgaagattattctctcttctaaagaaaatagaagaatattaggagaaaagacacttgaaaatgttcactcttttattcacattacatcatctgtcttgaataatgggtctatctctttcctgttgctctggccctgaaaaaaaaattagctttttaaggctgcttttgttacgtgtgcattttcttgtaatcctgtcattctgggatttaataataatagtattaataccacctaccatttgttggttacttactgtgttttaggcactgtgctaaacgccttccatgtattcatctcattagtaaacatttctgaaactatt

SEQ ID NO: 322072 - DNA, 516 bp, Homo sapiens
gatatatttagttggagttaagagcgttgggctcccataaagcagtagggctctccttgagtttagtttatatatatttagttggagttaagagtgttgggctcccataaagcggaagggttctccttgagtgctgcatcatctgtcttagatcccgatttccccataatcatgtttattatcctttccaggttgaagattattctctcttctaaagaaaatagaagaatattaggagaaaagacacttgaaaatgttcactcttttattcacattacatcatctgtcttgaataatgggtctatctctttcctgttgctctggccctgaaaaaaaaattagctttttaaggctgcttttgttacgtgtgcattttcttgtaatcctgtcattctgggatttaataataatagtattaataccacctaccatttgttggttacttactgtgttttaggcactgtgctaaacgccttccatgtattcatctcattagtaaacatttctgaaactatt

SEQ ID NO: 322073 - DNA, 760 bp, Homo sapiens
ggattacaggcgtgagccactgcgcccagcctccctgtgtgtatttctttgtgtccacaatttccccttttttataaggacaagtcataatgggattagagtcctccctgatgacctcattttaactttatgacctctttggagatcttatctctttcttttttttcagagtctctctttgttgcccaggctggagtacagtggggtgatctcagctcactgcaacctcctcctcctaggttcaagtgattcttctgccttagccttccaagtagctggagttacaggtgctcgccaccatgcctagctaatttttacatttttggtagagatggggtttctccacattggccaggctggtctcgaactcctgacctcaagtggtccacccacctcggcctcttaaagtgctgagattgcaggcgtgagccaccgcacctggtctgaagatcccatctctaagatcacattctgagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggtaaaatctccaattatagcagctgttct

SEQ ID NO: 322074 - DNA, 1031 bp, Homo sapiens
ccccgcccccacttctaggcttggttgaaccgtgcagataccttctcgaaacaaaagattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggatctccctaatactatgaacgcggcagagataacggacaagctcggcctccattccctccgctacagaaactggcacattcaggctacttgtgccactactggacatgggctttacgaaggcctgaactggctcgccaaccagttccagaaccagaactgatcagaaggatctattctttgtgccttgtggccacatcagctagcctctgctgtgtgcacgtgtacgtgtgtgctgggagtggaggcagctttctcacagtgccttatccatgccataagaaaagcagtgttacattttaagaaacccagtgttaagttttaaacaccaccttccatttcagtagctttgatgatcatttttgcaattgatggagaagtccagagggcttgctggtgctcgaaggccagagcgggcttcatggaggcgagttggagcggggactgagttcagctgttgcaatcctggtctggcgtctggagtcctgttagtctttggcatcctttcgtaaaaaggaaggaattgtcattcttttttttttaaaaccatatttttactgtaccttttcatgtttatttattttttattaaaaaaattttttttga

SEQ ID NO: 322075 - DNA, 2487 bp, Homo sapiens
gctcctgagtagctgggattacaggcgccctccaccacgcccggcgaatttttgtatctttagtagagacagggtttcaccacgttggccaggttggtcttgaactcctgacctcatgatccgcctgcctcggcctcccaaagtgttgggattacaggtgtgagccaccgcacccggcctctgagaaatatttagattgtacgcctcaaatgggcagggactgtgtcttacacttttgtatttatgctacagcttacctaatacagtgccaggcctcgttaaacacttattgattgctcagacgataaagaacttgctttggaaggaggagaggatagtcatgtgcttctgaatgtattgaacttcttgaaatctctttcctcatcaattttagcagagtttctattgaaactcctagggtgtgtttatggaagacaaactgagatgtgctgtcccagccttaggccctggcagtacgccttgccttttcacggcacacccactacagcctttcccacactgtgacactggagctggtgagtcagatgcatggcatgggaagccctctctaggaggatgctgtggccacacaagcgctggacgaaccgctggagtaggtgacttccaaggtgtcctgatgtagtagctattagacaagctcctgcatttggccagtaattagcatgctgctgcacattgccactaggtggtgctgctgctccattcccaagtaacccacatgcatccctggctggggtcagccttggggtttcccaagtgtagaggaatccatctctgtgcctgtggtaatggctggacaccaggagagacccagaaaacagggatatcctagaagagaaaggcaaaataagcactcagagcagaggacatttgagtgtcaataatgaaggtggcagcagtaatcatggctatcatttactaaaaatagtggatattggccagacatggtggctcacacctgtaatcccagcattttgggagaccaaggtgggtggatcacttgaggtcggcagttcgagaccagcccggccaacatggtgaaactatctactaaaaatacaaaaattagccaggtgtggtggtgcacgcctgtagtcccagctacttgggaggctgaggagggagaatcacttgaacctgggaggtggaggctgtagtgagctgagatcgcatcactgcactccagcctggacaacagagcaagactgtctcaaaaaaaaaaagtagatactgtgctagtcacttgatacacatcatctctgatctttgcactgagcgaggcatgtgtattatgtctgcattacaaaaggggaaaaattaaggttcaagaagataaagtcaccaggcatggtggcgcatgcctgtgatcgcagcactttaagaggctgagacaggcggattggttgaatccaggagttcaagaccagcctgggcaacatagtgagacctcatctctacaaaaaaaataaaattagctgggtgtggtggtgtgtgcctgtagtcacagctcctcgggaggctgatgtggaaggatcacttgagcccgggagatagaggctgcagtgagatgagactgagccattgcactcagcctaggcaacagagtgagaccctgtctcaaaacaaaacagaaataacaaaaaataaggtgacttgctggaggccacatggctgtgagccaaatacaggtctgggttatcagggctcacatacttctaagtacaccctactgccttggaatctgctgaagaccaagcccctgcccccaagccatggcaaagaaggagggaaggaagcaaaggtgcccagcggggacaactcggggaggggcgaggtgcccagggcccaggaaggccaagcagcatgtggcagggcagcatcaggtgactcccaagaaggaatgaggagaggatatgaggaaagagccacagcacagaggcctgctgttaggtcagcggagaccacggcccatgggacctggatctacccttgatgctaacaatgttctttggggaaaaaatctataatcacaaagtttctgcaactggactgtagtcatggttgcagaactgtatagatttactaggaaccatcaaattgttcacttacaatgggtaaattgtacagtacataggttatccctcagtaaagctgtatgaaatttatagtcatgaaactaatagtgacaaacgagctgggtaagtaggtctcagctgttctgtaggcactttgagaagaggaagagtagcatctcggttttaataaaagaaagcctggcccatggcgtccagcttctgcttgaatactttcagtgcccgggagctcagtatctcaaagcagcccactcctgtttaagagaactctaaaccttagaatgttgaaatacatcattattattctagtactgctgtgaaaaataaatgtctttgttttgccacataaaaaaaaaaaaccagggcggccgct

SEQ ID NO: 322076 - DNA, 2608 bp, Homo sapiens
ccccgcccccacttctaggcttggttgaaccgtgcagataccttctcgaaacaaaagattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccagtttgccccggtctcagagtgtgggatccagcactgcccatataacgttcccaggatgttctgactgatgtagagtaagcctggtatcacccatgtcctaggaactgagaccccgtcactactggttctcactctgtcacctaagctggagtgcagtggcaccatctcagctcactgcaactgctgcctcccgggttcaagcaattcttttacctcagcccccccagtagctgggatcacagtgcatggcatgggaagccctctctaggaggatgctgtggccacacaagcgctggacgaaccgctggagtaggtgacttccaaggtgtcctgatgtagtagctattagacaagctcctgcatttggccagtaattagcatgctgctgcacattgccactaggtggtgctgctgctccattcccaagtaacccacatgcatccctggctggggtcagccttggggtttcccaagtgtagaggaatccatctctgtgcctgtggtaatggctggacaccaggagagacccagaaaacagggatatcctagaagagaaaggcaaaataagcactcagagcagaggacatttgagtgtcaataatgaaggtggcagcagtaatcatggctatcatttactaaaaatagtggatattggccagacatggtggctcacacctgtaatcccagcattttgggagaccaaggtgggtggatcacttgaggtcggcagttcgagaccagcccggccaacatggtgaaactatctactaaaaatacaaaaattagccaggtgtggtggtgcacgcctgtagtcccagctacttgggaggctgaggagggagaatcacttgaacctgggaggtggaggctgtagtgagctgagatcgcatcactgcactccagcctggacaacagagcaagactgtctcaaaaaaaaaaagtagatactgtgctagtcacttgatacacatcatctctgatctttgcactgagcgaggcatgtgtattatgtctgcattacaaaaggggaaaaattaaggttcaagaagataaagtcaccaggcatggtggcgcatgcctgtgatcgcagcactttaagaggctgagacaggcggattggttgaatccaggagttcaagaccagcctgggcaacatagtgagacctcatctctacaaaaaaaataaaattagctgggtgtggtggtgtgtgcctgtagtcacagctcctcgggaggctgatgtggaaggatcacttgagcccgggagatagaggctgcagtgagatgagactgagccattgcactcagcctaggcaacagagtgagaccctgtctcaaaacaaaacagaaataacaaaaaataaggtgacttgctggaggccacatggctgtgagccaaatacaggtctgggttatcagggctcacatacttctaagtacaccctactgccttggaatctgctgaagaccaagcccctgcccccaagccatggcaaagaaggagggaaggaagcaaaggtgcccagcggggacaactcggggaggggcgaggtgcccagggcccaggaaggccaagcagcatgtggcagggcagcatcaggtgactcccaagaaggaatgaggagaggatatgaggaaagagccacagcacagaggcctgctgttaggtcagcggagaccacggcccatgggacctggatctacccttgatgctaacaatgttctttggggaaaaaatctataatcacaaagtttctgcaactggactgtagtcatggttgcagaactgtatagatttactaggaaccatcaaattgttcacttacaatgggtaaattgtacagtacataggttatccctcagtaaagctgtatgaaatttatagtcatgaaactaatagtgacaaacgagctgggtaagtaggtctcagctgttctgtaggcactttgagaagaggaagagtagcatctcggttttaataaaagaaagcctggcccatggcgtccagcttctgcttgaatactttcagtgcccgggagctcagtatctcaaagcagcccactcctgtttaagagaactctaaaccttagaatgttgaaatacatcattattattctagtactgctgtgaaaaataaatgtctttgttttgccacataaaaaaaaaaaaccagggcggccgct

SEQ ID NO: 322077 - DNA, 2944 bp, Homo sapiens
aggtccggggctgggggagctgcctttggcactggtgcccctgggggtgggggcacgagtgggccagggtgatggtgaggtagaggaggtgtccctgacccgacgagctcgagggagcggcctggctgggaggcggggggccgcggggcccggggagcgggcgccgccgagggccctggaagcggcggggctgggggagaggggacgcgtgtgtggggcacggggacgcccgcccagcgcccactcgtaggcctgggacgcgggctgccggccgagtggcctgagggcctggctgcccggggggcgggccggggccgcggccgggggcgcggagcggagctcggggcgccaggccgagccgaggtgggacggaccgacgcggagaggaagggaagccgcatcccgcggggcgcccctcctgaagcgagccgggcagcggccgcgggcgcccctgccctgagcccaccccgcgctctgccctccctaacaatgggaatggggcagaaggaggcgccccactgcggggaggtgaggggtgggtttgggactggggtccgcggtggggggaggtgcgatctcgggctctcgcctctccgctccctctggctctggagttgggggcccctgtggggctctgaagtccgcctgagacttgggtcaagagtcaaactgtcgccccccgctcctcccccaaaatccggtgagcggtaaggaaagtgatgccaagtcttcgaagcctcagtgacaaacgcatagcaagaacacatccactccagagataccttctcgaaacaaaagattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggctggagtgcaatggcgctaccttggctcaccgcaacttccgcctcctgggctcaagcaattctcctgcctcagcctcccgagtagctgggattacaggatctccctaatactatgaacgcggcagagataacggacaagctcggcctccattccctccgctacagaaactggcacattcaggctacttgtgccactactggacatgggctttacgaaggcctgaactggctcgccaaccagttccagaaccagaactgatcagaaggatctattctttgtgccttgtggccacatcagctagcctctgctgtgtgcacgtgtacgtgtgtgctgggagtggaggcagctttctcacagtgccttatccatgccataagaaaagcagtgttacattttaagaaacccagtgttaagttttaaacaccaccttccatttcagtagctttgatgatcatttttgcaattgatggagaagtccagagggcttgctggtgctcgaaggccagagcgggcttcatggaggcgagttggagcggggactgagttcagctgttgcaatcctggtctggcgtctggagtcctgttagtctttggcatcctttcgtaaaaaggaaggaattgtcattcttttttttttaaaaccatatttttactgtaccttttcatgtttatttattttttattaaaaaaattttttttgaaacagcctcccactctgtcgcccaagctggagtgcagtggtgcgatctcagctcactgcaacctccgtctctcgggctcaagcaatcctcccacctcagccccctgagtagctgagactatgggtgtgcaccaccacacctggctaatttttgtattttttgtggagacagggtcttgccatgttgcccaggctggtctgtaactcctgagctcaagggatccacccacctcagccttccaaaatgctgggattacaggcatgagccactgcgctaccgagaaatcgtcattctttaccaccactgctgcagctagcagctcactcttcagtgctttaagcaaatgatcctcaggaaagaaaaggtatttgcttattgcaggtgcaaagaggctcagattggaacttttccctgaaactatattgtagcccagagttcctgatgtaagacgctttatttaaagacatccgtgagctttttcactggcatatcaatacttcataacactaggaaggtatccagccttttccttatgctagttccttcccttatttgccagatggggaccctgtggggaggtgacccagtgtgaggccgaagctctttcccagagccccacaggccagtggagggtcgtgtttgtgctctgggcatcaccgtcttgggtctcggtcccctgcgactgcagctgctacatccctccctgctctgagataaatgttcttcccatgaagcagacggttcacttttgggatggcgctgtctccaggtttggctgtctcagtccagatgatgtttggttagtttccattcccagaaccacaagcctttgagttctgaaagtttgtgacagaatcaagaggctaatttgggagatgtgagattcccagcccacctggtattgccctcgagttagtggtaaattttgctatggaaaatatctcttgtcaagaccaagctccggcgcattgcctccctcttttggatggccatggcatctcatgaaccacttggaaatgtgttttatgttgttctccaaatattaataaaaatatcccggagaggaggttcact

SEQ ID NO: 322078 - DNA, 2913 bp, Homo sapiens
ggattacaggcgtgagccactgcgcccagcctccctgtgtgtatttctttgtgtccacaatttccccttttttataaggacaagtcataatgggattagagtcctccctgatgacctcattttaactttatgacctctttggagatcttatctctttcttttttttcagagtctctctttgttgcccaggctggagtacagtggggtgatctcagctcactgcaacctcctcctcctaggttcaagtgattcttctgccttagccttccaagtagctggagttacaggtgctcgccaccatgcctagctaatttttacatttttggtagagatggggtttctccacattggccaggctggtctcgaactcctgacctcaagtggtccacccacctcggcctcttaaagtgctgagattgcaggcgtgagccaccgcacctggtctgaagatcccatctctaagatcacattctgagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccagtttgccccggtctcagagtgtgggatccagcactgcccatataacgttcccaggatgttctgactgatgtagagtaagcctggtatcacccatgtcctaggaactgagaccccgtcactactggttctcactctgtcacctaagctggagtgcagtggcaccatctcagctcactgcaactgctgcctcccgggttcaagcaattcttttacctcagcccccccagtagctgggatcacagtgcatggcatgggaagccctctctaggaggatgctgtggccacacaagcgctggacgaaccgctggagtaggtgacttccaaggtgtcctgatgtagtagctattagacaagctcctgcatttggccagtaattagcatgctgctgcacattgccactaggtggtgctgctgctccattcccaagtaacccacatgcatccctggctggggtcagccttggggtttcccaagtgtagaggaatccatctctgtgcctgtggtaatggctggacaccaggagagacccagaaaacagggatatcctagaagagaaaggcaaaataagcactcagagcagaggacatttgagtgtcaataatgaaggtggcagcagtaatcatggctatcatttactaaaaatagtggatattggccagacatggtggctcacacctgtaatcccagcattttgggagaccaaggtgggtggatcacttgaggtcggcagttcgagaccagcccggccaacatggtgaaactatctactaaaaatacaaaaattagccaggtgtggtggtgcacgcctgtagtcccagctacttgggaggctgaggagggagaatcacttgaacctgggaggtggaggctgtagtgagctgagatcgcatcactgcactccagcctggacaacagagcaagactgtctcaaaaaaaaaaagtagatactgtgctagtcacttgatacacatcatctctgatctttgcactgagcgaggcatgtgtattatgtctgcattacaaaaggggaaaaattaaggttcaagaagataaagtcaccaggcatggtggcgcatgcctgtgatcgcagcactttaagaggctgagacaggcggattggttgaatccaggagttcaagaccagcctgggcaacatagtgagacctcatctctacaaaaaaaataaaattagctgggtgtggtggtgtgtgcctgtagtcacagctcctcgggaggctgatgtggaaggatcacttgagcccgggagatagaggctgcagtgagatgagactgagccattgcactcagcctaggcaacagagtgagaccctgtctcaaaacaaaacagaaataacaaaaaataaggtgacttgctggaggccacatggctgtgagccaaatacaggtctgggttatcagggctcacatacttctaagtacaccctactgccttggaatctgctgaagaccaagcccctgcccccaagccatggcaaagaaggagggaaggaagcaaaggtgcccagcggggacaactcggggaggggcgaggtgcccagggcccaggaaggccaagcagcatgtggcagggcagcatcaggtgactcccaagaaggaatgaggagaggatatgaggaaagagccacagcacagaggcctgctgttaggtcagcggagaccacggcccatgggacctggatctacccttgatgctaacaatgttctttggggaaaaaatctataatcacaaagtttctgcaactggactgtagtcatggttgcagaactgtatagatttactaggaaccatcaaattgttcacttacaatgggtaaattgtacagtacataggttatccctcagtaaagctgtatgaaatttatagtcatgaaactaatagtgacaaacgagctgggtaagtaggtctcagctgttctgtaggcactttgagaagaggaagagtagcatctcggttttaataaaagaaagcctggcccatggcgtccagcttctgcttgaatactttcagtgcccgggagctcagtatctcaaagcagcccactcctgtttaagagaactctaaaccttagaatgttgaaatacatcattattattctagtactgctgtgaaaaataaatgtctttgttttgccacataaaaaaaaaaaaccagggcggccgct

SEQ ID NO: 322079 - DNA, 1492 bp, Homo sapiens
aggtccggggctgggggagctgcctttggcactggtgcccctgggggtgggggcacgagtgggccagggtgatggtgaggtagaggaggtgtccctgacccgacgagctcgagggagcggcctggctgggaggcggggggccgcggggcccggggagcgggcgccgccgagggccctggaagcggcggggctgggggagaggggacgcgtgtgtggggcacggggacgcccgcccagcgcccactcgtaggcctgggacgcgggctgccggccgagtggcctgagggcctggctgcccggggggcgggccggggccgcggccgggggcgcggagcggagctcggggcgccaggccgagccgaggtgggacggaccgacgcggagaggaagggaagccgcatcccgcggggcgcccctcctgaagcgagccgggcagcggccgcgggcgcccctgccctgagcccaccccgcgctctgccctccctaacaatgggaatggggcagaaggaggcgccccactgcggggaggtgaggggtgggtttgggactggggtccgcggtggggggaggtgcgatctcgggctctcgcctctccgctccctctggctctggagttgggggcccctgtggggctctgaagtccgcctgagacttgggtcaagagtcaaactgtcgccccccgctcctcccccaaaatccggtgagcggtaaggaaagtgatgccaagtcttcgaagcctcagtgacaaacgcatagcaagaacacatccactccagagataccttctcgaaacaaaagattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggttgaagattattctctcttctaaagaaaatagaagaatattaggagaaaagacacttgaaaatgttcactcttttattcacattacatcatctgtcttgaataatgggtctatctctttcctgttgctctggccctgaaaaaaaaattagctttttaaggctgcttttgttacgtgtgcattttcttgtaatcctgtcattctgggatttaataataatagtattaataccacctaccatttgttggttacttactgtgttttaggcactgtgctaaacgccttccatgtattcatctcattagtaaacatttctgaaactatt

SEQ ID NO: 322080 - DNA, 1337 bp, Homo sapiens
aggtccggggctgggggagctgcctttggcactggtgcccctgggggtgggggcacgagtgggccagggtgatggtgaggtagaggaggtgtccctgacccgacgagctcgagggagcggcctggctgggaggcggggggccgcggggcccggggagcgggcgccgccgagggccctggaagcggcggggctgggggagaggggacgcgtgtgtggggcacggggacgcccgcccagcgcccactcgtaggcctgggacgcgggctgccggccgagtggcctgagggcctggctgcccggggggcgggccggggccgcggccgggggcgcggagcggagctcggggcgccaggccgagccgaggtgggacggaccgacgcggagaggaagggaagccgcatcccgcggggcgcccctcctgaagcgagccgggcagcggccgcgggcgcccctgccctgagcccaccccgcgctctgccctccctaacaatgggaatggggcagaaggaggcgccccactgcggggaggtgaggggtgggtttgggactggggtccgcggtggggggaggtgcgatctcgggctctcgcctctccgctccctctggctctggagttgggggcccctgtggggctctgaagtccgcctgagacttgggtcaagagtcaaactgtcgccccccgctcctcccccaaaatccggtgagcggtaaggaaagtgatgccaagtcttcgaagcctcagtgacaaacgcatagcaagaacacatccactccagagataccttctcgaaacaaaagattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggttgaagattattctctcttctaaagaaaatagaagaatattaggagaaaagacacttgaaaatgttcactcttttattcacattacatcatctgtcttgaataatgggtctatctctttcctgttgctctggccctgaaaaatctgggtttaatataataggttaatac

SEQ ID NO: 322081 - DNA, 1196 bp, Homo sapiens
aggtccggggctgggggagctgcctttggcactggtgcccctgggggtgggggcacgagtgggccagggtgatggtgaggtagaggaggtgtccctgacccgacgagctcgagggagcggcctggctgggaggcggggggccgcggggcccggggagcgggcgccgccgagggccctggaagcggcggggctgggggagaggggacgcgtgtgtggggcacggggacgcccgcccagcgcccactcgtaggcctgggacgcgggctgccggccgagtggcctgagggcctggctgcccggggggcgggccggggccgcggccgggggcgcggagcggagctcggggcgccaggccgagccgaggtgggacggaccgacgcggagaggaagggaagccgcatcccgcggggcgcccctcctgaagcgagccgggcagcggccgcgggcgcccctgccctgagcccaccccgcgctctgccctccctaacaatgggaatggggcagaaggaggcgccccactgcggggaggtgaggggtgggtttgggactggggtccgcggtggggggaggtgcgatctcgggctctcgcctctccgctccctctggctctggagttgggggcccctgtggggctctgaagtccgcctgagacttgggtcaagagtcaaactgtcgccccccgctcctcccccaaaatccggtgagcggtaaggaaagtgatgccaagtcttcgaagcctcagtgacaaacgcatagcaagaacacatccactccagagataccttctcgaaacaaaagattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggtaaaatctccaattatagcagctgttct

SEQ ID NO: 322082 - DNA, 2846 bp, Homo sapiens
aggtccggggctgggggagctgcctttggcactggtgcccctgggggtgggggcacgagtgggccagggtgatggtgaggtagaggaggtgtccctgacccgacgagctcgagggagcggcctggctgggaggcggggggccgcggggcccggggagcgggcgccgccgagggccctggaagcggcggggctgggggagaggggacgcgtgtgtggggcacggggacgcccgcccagcgcccactcgtaggcctgggacgcgggctgccggccgagtggcctgagggcctggctgcccggggggcgggccggggccgcggccgggggcgcggagcggagctcggggcgccaggccgagccgaggtgggacggaccgacgcggagaggaagggaagccgcatcccgcggggcgcccctcctgaagcgagccgggcagcggccgcgggcgcccctgccctgagcccaccccgcgctctgccctccctaacaatgggaatggggcagaaggaggcgccccactgcggggaggtgaggggtgggtttgggactggggtccgcggtggggggaggtgcgatctcgggctctcgcctctccgctccctctggctctggagttgggggcccctgtggggctctgaagtccgcctgagacttgggtcaagagtcaaactgtcgccccccgctcctcccccaaaatccggtgagcggtaaggaaagtgatgccaagtcttcgaagcctcagtgacaaacgcatagcaagaacacatccactccagagataccttctcgaaacaaaagattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggatctccctaatactatgaacgcggcagagataacggacaagctcggcctccattccctccgctacagaaactggcacattcaggctacttgtgccactactggacatgggctttacgaaggcctgaactggctcgccaaccagttccagaaccagaactgatcagaaggatctattctttgtgccttgtggccacatcagctagcctctgctgtgtgcacgtgtacgtgtgtgctgggagtggaggcagctttctcacagtgccttatccatgccataagaaaagcagtgttacattttaagaaacccagtgttaagttttaaacaccaccttccatttcagtagctttgatgatcatttttgcaattgatggagaagtccagagggcttgctggtgctcgaaggccagagcgggcttcatggaggcgagttggagcggggactgagttcagctgttgcaatcctggtctggcgtctggagtcctgttagtctttggcatcctttcgtaaaaaggaaggaattgtcattcttttttttttaaaaccatatttttactgtaccttttcatgtttatttattttttattaaaaaaattttttttgaaacagcctcccactctgtcgcccaagctggagtgcagtggtgcgatctcagctcactgcaacctccgtctctcgggctcaagcaatcctcccacctcagccccctgagtagctgagactatgggtgtgcaccaccacacctggctaatttttgtattttttgtggagacagggtcttgccatgttgcccaggctggtctgtaactcctgagctcaagggatccacccacctcagccttccaaaatgctgggattacaggcatgagccactgcgctaccgagaaatcgtcattctttaccaccactgctgcagctagcagctcactcttcagtgctttaagcaaatgatcctcaggaaagaaaaggtatttgcttattgcaggtgcaaagaggctcagattggaacttttccctgaaactatattgtagcccagagttcctgatgtaagacgctttatttaaagacatccgtgagctttttcactggcatatcaatacttcataacactaggaaggtatccagccttttccttatgctagttccttcccttatttgccagatggggaccctgtggggaggtgacccagtgtgaggccgaagctctttcccagagccccacaggccagtggagggtcgtgtttgtgctctgggcatcaccgtcttgggtctcggtcccctgcgactgcagctgctacatccctccctgctctgagataaatgttcttcccatgaagcagacggttcacttttgggatggcgctgtctccaggtttggctgtctcagtccagatgatgtttggttagtttccattcccagaaccacaagcctttgagttctgaaagtttgtgacagaatcaagaggctaatttgggagatgtgagattcccagcccacctggtattgccctcgagttagtggtaaattttgctatggaaaatatctcttgtcaagaccaagctccggcgcattgcctccctcttttggatggccatggcatctcatgaaccacttggaaatgtgttttatgttgttctccaaatattaataaaaatatcccggagaggaggttcact

SEQ ID NO: 322083 - DNA, 1683 bp, Homo sapiens
aggtccggggctgggggagctgcctttggcactggtgcccctgggggtgggggcacgagtgggccagggtgatggtgaggtagaggaggtgtccctgacccgacgagctcgagggagcggcctggctgggaggcggggggccgcggggcccggggagcgggcgccgccgagggccctggaagcggcggggctgggggagaggggacgcgtgtgtggggcacggggacgcccgcccagcgcccactcgtaggcctgggacgcgggctgccggccgagtggcctgagggcctggctgcccggggggcgggccggggccgcggccgggggcgcggagcggagctcggggcgccaggccgagccgaggtgggacggaccgacgcggagaggaagggaagccgcatcccgcggggcgcccctcctgaagcgagccgggcagcggccgcgggcgcccctgccctgagcccaccccgcgctctgccctccctaacaatgggaatggggcagaaggaggcgccccactgcggggaggtgaggggtgggtttgggactggggtccgcggtggggggaggtgcgatctcgggctctcgcctctccgctccctctggctctggagttgggggcccctgtggggctctgaagtccgcctgagacttgggtcaagagtcaaactgtcgccccccgctcctcccccaaaatccggtgagcggtaaggaaagtgatgccaagtcttcgaagcctcagtgacaaacgcatagcaagaacacatccactccagagataccttctcgaaacaaaagattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccagtttgccccggtctcagagtgtgggatccagcactgcccatataacgttcccaggatgttctgactgatgtagagttctcactctgtcacctaagctggagtgcagtggcaccatctcagctcactgcaactgctgcctcccgggttcaagcaattcttttacctcagcccccccagtagctgggatcacaggttgaagattattctctcttctaaagaaaatagaagaatattaggagaaaagacacttgaaaatgttcactcttttattcacattacatcatctgtcttgaataatgggtctatctctttcctgttgctctggccctgaaaaaaaaattagctttttaaggctgcttttgttacgtgtgcattttcttgtaatcctgtcattctgggatttaataataatagtattaataccacctaccatttgttggttacttactgtgttttaggcactgtgctaaacgccttccatgtattcatctcattagtaaacatttctgaaactatt

SEQ ID NO: 322084 - DNA, 2527 bp, Homo sapiens
cccgccgcagccggccgcagccggccgcacccttccccgtccgtccatgtccctgcccgtggtgctcccgggctcctgctgccccgtggctgggctttcgggtgggccgcaggccgggggcccgggcgccgctgccgccgccgctcaggagccgccgctgcccccgctgcggccgcgctggccccggggcgcgctgcagcccccgtcgcggcctcgctgcgcggccaccgctgctgccggggtgctggccgcgccgccggcgctctcctcccgccgggcagtcgccgccgctgccgccgcggccccgggctccgcgctgctgcccgcccgcccgctgctgtcacttgggctgcttcagctgatcttgggctgctgcatggtggcgctcagcttcggggcgctgtcgctgagcagctccccgcaggtgaagaactcgtgcccgttctgggccggctcctcggtgatactctctggaatcataggattaacaacttggaaaaggcctatgatactcctggtaaacctctttgtgctgctctctgtggtttgtgtcctcttaaatctagctggatttatcctaggctgccaaggggcccagtttgtgtccagcgtgcccaggtgtgatctggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtggtgagccagatggaccaggagcagggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggccactgggcttgatgtgta

SEQ ID NO: 322085 - DNA, 2117 bp, Homo sapiens
gggaattgctatccctggggaaatcagcctcagaagagaagctcactgctctcctggaaggaatgtttctcgacagtattctgatgcttgcaaaaagaaatactatcataccacgttgttctgtgacagaaagcttctaagataagtttttggaattaagaagtacacattattgcatgagggtcataataatagccagcatttatttgggcactttccacgagccaaacaccatctaagtcctttacatgcatcctctcctgagaattgtcttatggaggcagcgttattattattttaaagattttctacattgtattctggtgatgtttgttgaagtacttagtggtgccattgtttccttgccccagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtgggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggccactgggcttgatgtgta

SEQ ID NO: 322086 - DNA, 1514 bp, Homo sapiens
tctaaattgctgcttatcaggccttcatagactgaagatgccaatgttgtgtatgctgaaggctgctggctgacttctggacacataatgaccagatctgagttttgcttcacacacttcacagtgcagaagcattgctggtctttacacccttgctgatataggcagccatggaaattagagcctgcagtggatttcccaggctctctgttgacttccagaatgatgtgtactttttctgcacctaaatttctcttttggtaatagctatagatctacctcatatccatggtgtgagcatcgataacacaagtcagtacaacgtccttgaggacttttgggacaaagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggccactgggcttgatgtgta

SEQ ID NO: 322087 - DNA, 392 bp, Homo sapiens
aagtcattgtcatcaaaagaatttggttgtacatgatactatgctaggtactacatgaagacaattatgcacacctagttctgatttctagatgctgcaatcctataggaatatgcattgtcttaaaaaaagtcaaaaggatttttgtatactccctcttttataatttgttatatttttactatgtatgagtagatgattgaattattgaaatctgaccttgtttttagaactttggatagaatgaagtacacgcacccacacaattcacctctctctctgtgttgtttgtgtatagatgttacctgaataattaaaaattaaaataataacactgacttttttctgaatatatgaatacctgaacatctctaaatatctcttcattgtag

SEQ ID NO: 322088 - DNA, 313 bp, Homo sapiens
tgtgtgccttgaatgccctgaccaccaccgtctgcttggtggccgctgccctccgctacctccagatattcgcaaccaggagatcctgcatcgtaagtctatgcaagggcatcatggccacgtttccgctgagccagcccatggaccccttcgtgtcatccactgcctctctccccgtgcctttgtaatgaaggctgttgactaactgagctgctgtttaatcaggatgaatcccagatttctgctgaagaagcggaggatcatggacgcatccccgaccctgatgattttgtgccgcctgtgcctccccctt

SEQ ID NO: 322089 - DNA, 1461 bp, Homo sapiens
ttatggtttgcattctggattctcctctccaccatctggctttaccttgggggtggtgtcgtacatgacacaatgacgtgtttcgggccatatcctattggaactggacttcagggaataaccttgtgttatagttgttttccctccttctgcaagatgaaaagcaggatgtgcatggctatcagcatttgtcagatgctttccatgttgagttttgtggtctgtgctttcaggtacaggcatatgttcaaaaggggttggccaatgggtacatgttgtttgtttctgcccacagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggccactgggcttgatgtgta

SEQ ID NO: 322090 - DNA, 2503 bp, Homo sapiens
cccgccgcagccggccgcagccggccgcacccttccccgtccgtccatgtccctgcccgtggtgctcccgggctcctgctgccccgtggctgggctttcgggtgggccgcaggccgggggcccgggcgccgctgccgccgccgctcaggagccgccgctgcccccgctgcggccgcgctggccccggggcgcgctgcagcccccgtcgcggcctcgctgcgcggccaccgctgctgccggggtgctggccgcgccgccggcgctctcctcccgccgggcagtcgccgccgctgccgccgcggccccgggctccgcgctgctgcccgcccgcccgctgctgtcacttgggctgcttcagctgatcttgggctgctgcatggtggcgctcagcttcggggcgctgtcgctgagcagctccccgcaggtgaagaactcgtgcccgttctgggccggctcctcggtgatactctctggaatcataggattaacaacttggaaaaggcctatgatactcctggtaaacctctttgtgctgctctctgtggtttgtgtcctcttaaatctagctggatttatcctaggctgccaaggggcccagtttgtgtccagcgtgcccaggtgtgatctggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtgggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggccactgggcttgatgtgta

SEQ ID NO: 322091 - DNA, 1859 bp, Homo sapiens
tcgtaaccatcatctttatctagttccaaagcattttcagtacttcagagagaccccatacccatcaaacaccactaatctgctctgtgtctctatggattgtttgctttttgactgatgggtttaaaagcaatgatggggttgcattttatacactgtcatttgcttaaggaactctggccacttcgtcggagagcagcttctattattctccctctcctggccaaggagaccatggtatggagaggtgagtggttttccccacagtttagagcaaagccagtatccgggcatcactgcagtcacgtggccagtctgtagaacgtgctttctgacgccaagtcgcttttcctaggatggttggtcctgatgttattcccctgccacacatctacggagctcgaatcaaaggtgtggaagtgttctgtcctctggatcccccgccgccatatgaagctgtgggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggccactgggcttgatgtgta

SEQ ID NO: 322092 - DNA, 2022 bp, Homo sapiens
cccgccgcagccggccgcagccggccgcacccttccccgtccgtccatgtccctgcccgtggtgctcccgggctcctgctgccccgtggctgggctttcgggtgggccgcaggccgggggcccgggcgccgctgccgccgccgctcaggagccgccgctgcccccgctgcggccgcgctggccccggggcgcgctgcagcccccgtcgcggcctcgctgcgcggccaccgctgctgccggggtgctggccgcgccgccggcgctctcctcccgccgggcagtcgccgccgctgccgccgcggccccgggctccgcgctgctgcccgcccgcccgctgctgtcacttgggctgcttcagctgatcttgggctgctgcatggtggcgctcagcttcggggcgctgtcgctgagcagctccccgcaggtgaagaactcgtgcccgttctgggccggctcctcggtgatactctctggaatcataggattaacaacttggaaaaggcctatgatactcctggtaaacctctttgtgctgctctctgtggtttgtgtcctcttaaatctagctggatttatcctaggctgccaaggggcccagtttgtgtccagcgtgcccaggtgtgatctggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtggtgagccagatggaccaggagcagggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagaaaattataaaaaataaagaaactaaaggaagaaaattaaaatctcctgtaactccaccagcaccagcttcttcttgtgaagtagtctagcagagttgacctctgctgttctaaaacacctatgcaaataaaactttgataatcctccaccctgctctctctaaggtcctgtcttgagcccttgcagtctcggttctggctctctgacagtgtgtgttatttgccacagctctggactgaccatgtgcgagccagagagaacattcctcttgtctctacagcagcttctaagtggagaggaagtcctgccgcctggtactgagcgtgtctctgaaacacagtggccaggcagcctggcttctgattcccaagacctgccttcactgtgggtctcctacaccctacctggcaagttgaggactccagcctcaacgggaacttagctgtttgcacagcttagggaaatctttccagaaccccttctcattctgcagacctgcgggggcaagaacagcagctgctggagccctccattgtggaaggcgccaggttgccttcaagtggaagagtggagaccctgactctgtcctcacacgagtgtctttggcgagtgcttctggaagactcttgctgtctgtgacgtgcatatggctgcctgaga

SEQ ID NO: 322093 - DNA, 5240 bp, Homo sapiens
  misc_feature (896)..(896): n is a, c, g, or t
ggtagaccaacttaacactgaacccattacttttccaagaccagaaaaaaatattacatgaacaggaactacttctccttcagataagaattcaagctttgacattgtaaaccacagacgaattggagcttggcattgaaaggaggtgttctgcaatgattttttttcttgtttagagaagtttacttctacaagaagaaatctgaaaaatgacaggagcaaagaggaaaaagaaaagcatgctttggagcaagatgcataccccccagtgtgaagacattatacagtggtgtagaaggcgactgcccattttggattgggcaccacattacaatctgaaagaaaacttgcttccagacactgtgtctgggataatgttggcagttcaacaggtgacccaaggattggcctttgctgttctctcatctgtgcacccagtgtttggtttatatgggtctctgtttcctgccataatttatgccatatttggaatgggacatcatgttgccacaggcacctttgccttgacatccttaatatcagccaacgccgtggaacggattgtccctcagaacatgcagaatctcaccacacagagtaacacaagcgtgctgggcttatccgactttgaaatgcaaaggatccacgttgctgcagcagtttccttcttgggaggtgtgattcaggtggccatgtttgtgctgcaactgggcagtgccacatttgtggtcacagagcctgtgatcagcgcaatgacaactggggctgccacccatgtggtgacttcacaagtcaaatatctcttgggaatgaaaatgccatatatatccggaccacttggattcttttatatttatgcatatgtttttgaaaacatcaagtctgtgcgactggangcattgcttttatccttgctgagcattgtggtccttgttcttgttaaagagctgaatgaacagtttaaaaggaaaattaaagttgttcttcctgtagatttagttttgattattgctgcatcatttgcttgttattgcaccaatatggaaaacacatatggattagaagtagttggtcatattccacaaggaattccctcacctagagctcccccgatgaacatcctctctgcggtgatcactgaagctttcggagtggcacttgtaggctatgtggcctcactggctcttgctcaaggatctgccaaaaaattcaaatattcaattgatgacaaccaggaatttttggcccatggcctcagcaatatagtttcttcatttttcttctgcataccaagtgctgctgccatgggaaggacggctggcctgtacagcacaggagcgaagacacaggtggcttgtctaatatcttgcattttcgtccttatagtcatctatgcaataggacctttgctttactggctgcccatgtgtgtccttgcaagcattattgttgtgggactgaagggaatgctaatacagttccgagatttaaaaaaatattggaatgtggataaaatcgattggggaatatgggtcagtacatatgtatttacaatatgctttgctgccaatgtgggactgctgtttggtgttgtttgtaccatagctatagtgataggacgcttcccaagagcaatgactgtaagtataaaaaatatgaaagaaatggaatttaaagtgaagacagaaatggacagtgaaaccctgcagcaggtgaaaattatctcaataaacaacccgcttgttttcctgaatgcaaaaaaattttatactgatttaatgaacatgatccaaaaggaaaatgcctgtaatcagccacttgatgatatcagcaagtgtgaacaaaacacattgcttaattccctatccaatggcaactgcaatgaagaagcttcacagtcctgccctaatgagaagtgttatttaatcctggattgcagtggatttaccttttttgactattctggagtctccatgcttgttgaggtttacatggactgtaaaggcaggagtgtggatgtattgttagcccattgtacagcttccttgataaaagcaatgacgtattatggaaacctagactcagagaaaccaattttttttgaatcggtatctgctgcaataagtcatatccattcaaataagaatttgagcaaactcagtgaccacagtgaagtctgagacccttttgtcacagtacagctcttgtctttaccaactgcctgaagaggccatatgctggcattttgcacaactttttggttgtttagatcctacagatgacctctgctacaataagtacgatgtgacttagtaactgcatagcagttggaaagaactgccaacttttttttctcatttttgttagtaagaagattcgcttagttattttatgtaaaaatcagtatgtgtttagttttagtgtactgaagggtaaacatggttttattttattttaccatattattttgtgttgttttatttctattgtgctgtaagttgatgtttaaaattgagaaatacttttgtcataggtaatttggaacatttacaagccatttgtaaaattttaagataatctgtaactaatacataaaaacaacttagcaaatgtgccattttcacacaacttctctctgtataggcctctgaaatatcaataaggctaaatattactttacacagtaagatgtgaaattcacaaaaagtaaaccaaacaaaacgaatgaaaaactggaaataattcgtttccatatctttccatacatccatttctgaagtattcaggaatgttttcataatcgaaagaaacgggtatccaaataaaaccaagttcttgacattggtctgttttgctgtgaatattggaaatgcttaggatcttcagacccaatagctctaattttaacatttctacccaataagaggctctgttttccactgaagctttgttggagaaagagaatatgaaaattacacattttataatttttagatgagaaaataccactagcagaatagctttgtgctattccagtataagatgaactgtaataatttttgacttccctatttcagagatagtcaatataatatgtttatctatatccatatggatggataggtaggtagatcttcatagatttttttttcttttgttagaggagagcttgatgtgattatcttcaaacccaccaaaccaacaggataattgacaaataaacgccataggctaggctgaactgtatgttactgttttcatgcttatacatatattttcaatcacatacaagtacatagaatttcacattttaatttagcaaattgatttacctaggaaaaaattatcaccttcaaagataggcatagacacataattatgcttaagcttttaacagcattttaaccgctctaaaaattaccagagtaagaaaaagctaggtactttaaagtgagtttgagaaacaagttgaaactaaaattaaaataccagccatttaggtgctttctctggcatctataaaagtaaattctagtgcctgccaagtgatggattataatggtctctagcaaatgtgtggtaaacattcatatggccattaattttaacattaaatcgtaggtagggcaatgtagtaaaatgaaagagaattaagaaaggttttgaattcttataacatatccagccatttcaattttgattgaaatgaactacaaagaatagtgtttgtccctatggtagcctcagtctctttatcactaacttggattgaaatgagtgaggccaactcacattcccatcaaacactcttccaaggaaaagcagaagtaataattggaggtaaagtttccttagagaaaataattttattctgctttgtccaattaaattattccaatggcggatggtaatattcaccatctctaattcattggtcactggtaggtaagcatgagttaaggaaagtcaaaaatgaaaatatattttgctgtgtataaattgatattttgctatgcaactcctgtaattgaatttgtataatgcaggcactttctaatttattagagattatggatcagttctgacattaaaatcatagttaattgatggatggtttttatagtttgttgataaagtggacacagtattgtctgagcagttatattttaatgcatttcagtgtttatagtagaagtttagtggataaaactttaagtccaataacttgggggtcaaatgctaatgttttattcaatgtaaaggaagaccaaaccatgtaccttatgaagacctttgttttaagacttccacacaccaaggctacaatgactgttaacctggaggaagtctctggtatggagttctgagagcttaagagctaaacatgagtttagacacacaagattctaaaatgcaaatgtttattttgaagcaggcattgacaacacaaaaactgtgtagtggtcttgatgctggattgtttctagagtcacaatgaattatttttatgagattaccttatttttatatatgacaaactacttctataatgcttattatggtaaaataaaattggaaaaaattaaaactgacctataagagtgttaaggacctaatagagtgacatatataaattaagcataaaatatgtaaccaggaaaagactgttaacattacatttatgcaaattaaatgcccttaaatttcaccatttgtctttcattttaaaggttatttgctcccgattatatgattcaagtgttataagttttagcttgaactactttgcagtaatttatttgacagatctctattctataaatgtgtaatgtgatgaagaaagagatctttcttttttaatgaaaacattaatgtgttaataccctgtatggataatgcttgacatttagtggtttccaaaatatattagtatattgttgaacatacattatgccttagaaatgcacattctgtattttgtgggatgataatctaattcagtatagaatatgctgtttggcaatgagtttgtggccagatttcaaatagggagttaagtggtactttcacaatccaaagatttttagttaaaaatcatgtagtctaatatgctgcagttatttttttatatttttcaatgcatttaattatcttttttataattctttgtactaactcagcatgtaacaaccaatttacatggaaataaatcgaaatatgataactattatgcttaaaaa

SEQ ID NO: 322094 - DNA, 2644 bp, Homo sapiens
ttctgtttcttgtttctctttcagggaatatgggtcagtacatatgtatttacaatatgctttgctgccaatgtgggactgctgtttggtgttgtttgtaccatagctatagtgataggacgcttcccaagagcaatgactgtaagtataaaaaatatgaaagaaatggaatttaaagtgaagacagaaatggacagtgaaaccctgcagcaggtgaaaattatctcaataaacaacccgcttgttttcctgaatgcaaaaaaattttatactgatttaatgaacatgatccaaaaggaaaatgcctgtaatcagccacttgatgatatcagcaagtgtgaacaaaacacattgcttaattccctatccaatggcaactgcaatgaagaagcttcacagtcctgccctaatgagaagtgttatttaatcctggattgcagtggatttaccttttttgactattctggagtctccatgcttgttgaggtttacatggactgtaaaggcaggagtgtggatgtattgttagcccattgtacagcttccttgataaaagcaatgacgtattatggaaacctagactcagagaaaccaattttttttgaatcggtatctgctgcaataagtcatatccattcaaataagaatttgagcaaactcagtgaccacagtgaagtctgagacccttttgtcacagtacagctcttgtctttaccaactgcctgaagaggccatatgctggcattttgcacaactttttggttgtttagatcctacagatgacctctgctacaataagtacgatgtgacttagtaactgcatagcagttggaaagaactgccaacttttttttctcatttttgttagtaagaagattcgcttagttattttatgtaaaaatcagtatgtgtttagttttagtgtactgaagggtaaacatggttttattttattttaccatattattttgtgttgttttatttctattgtgctgtaagttgatgtttaaaattgagaaatacttttgtcataggtaatttggaacatttacaagccatttgtaaaattttaagataatctgtaactaatacataaaaacaacttagcaaatgtgccattttcacacaacttctctctgtataggcctctgaaatatcaataaggctaaatattactttacacagtaagatgtgaaattcacaaaaagtaaaccaaacaaaacgaatgaaaaactggaaataattcgtttccatatctttccatacatccatttctgaagtattcaggaatgttttcataatcgaaagaaacgggtatccaaataaaaccaagttcttgacattggtctgttttgctgtgaatattggaaatgcttaggatcttcagacccaatagctctaattttaacatttctacccaataagaggctctgttttccactgaagctttgttggagaaagagaatatgaaaattacacattttataatttttagatgagaaaataccactagcagaatagctttgtgctattccagtataagatgaactgtaataatttttgacttccctatttcagagatagtcaatataatatgtttatctatatccatatggatggataggtaggtagatcttcatagatttttttttcttttgttagaggagagcttgatgtgattatcttcaaacccaccaaaccaacaggataattgacaaataaacgccataggctaggctgaactgtatgttactgttttcatgcttatacatatattttcaatcacatacaagtacatagaatttcacattttaatttagcaaattgatttacctaggaaaaaattatcaccttcaaagataggcatagacacataattatgcttaagcttttaacagcattttaaccgctctaaaaattaccagagtaagaaaaagctaggtactttaaagtgagtttgagaaacaagttgaaactaaaattaaaataccagccatttaggtgctttctctggcatctataaaagtaaattctagtgcctgccaagtgatggattataatggtctctagcaaatgtgtggtaaacattcatatggccattaattttaacattaaatcgtaggtagggcaatgtagtaaaatgaaagagaattaagaaaggttttgaattcttataacatatccagccatttcaattttgattgaaatgaactacaaagaatagtgtttgtccctatggtagcctcagtctctttatcactaacttggattgaaatgagtgaggccaactcacattcccatcaaacactcttccaaggaaaagcagaagtaataattggaggtaaagtttccttagagaaaataattttattctgctttgtccaattaaattattccaatggcggatggtaatattcaccatctctaattcattggtcactggtaggtaagcatgagttaaggaaagtcaaaaatgaaaatatattttgctgtgtataaattgatattttgctatgcaactcctgtaattgaatttgtataatgcaggcacttttattacgccacagggttgtcacagctcagagagctattaaaatatagttcaagttgactggatggtattgcatagcttgttgacttgggt

SEQ ID NO: 322095 - DNA, 2137 bp, Homo sapiens
  misc_feature (896)..(896): n is a, c, g, or t
ggtagaccaacttaacactgaacccattacttttccaagaccagaaaaaaatattacatgaacaggaactacttctccttcagataagaattcaagctttgacattgtaaaccacagacgaattggagcttggcattgaaaggaggtgttctgcaatgattttttttcttgtttagagaagtttacttctacaagaagaaatctgaaaaatgacaggagcaaagaggaaaaagaaaagcatgctttggagcaagatgcataccccccagtgtgaagacattatacagtggtgtagaaggcgactgcccattttggattgggcaccacattacaatctgaaagaaaacttgcttccagacactgtgtctgggataatgttggcagttcaacaggtgacccaaggattggcctttgctgttctctcatctgtgcacccagtgtttggtttatatgggtctctgtttcctgccataatttatgccatatttggaatgggacatcatgttgccacaggcacctttgccttgacatccttaatatcagccaacgccgtggaacggattgtccctcagaacatgcagaatctcaccacacagagtaacacaagcgtgctgggcttatccgactttgaaatgcaaaggatccacgttgctgcagcagtttccttcttgggaggtgtgattcaggtggccatgtttgtgctgcaactgggcagtgccacatttgtggtcacagagcctgtgatcagcgcaatgacaactggggctgccacccatgtggtgacttcacaagtcaaatatctcttgggaatgaaaatgccatatatatccggaccacttggattcttttatatttatgcatatgtttttgaaaacatcaagtctgtgcgactggangcattgcttttatccttgctgagcattgtggtccttgttcttgttaaagagctgaatgaacagtttaaaaggaaaattaaagttgttcttcctgtagatttagttttgattattgctgcatcatttgcttgttattgcaccaatatggaaaacacatatggattagaagtagttggtcatattccacaaggaattccctcacctagagctcccccgatgaacatcctctctgcggtgatcactgaagctttcggagtggcacttgtaggctatgtggcctcactggctcttgctcaaggatctgccaaaaaattcaaatattcaattgatgacaaccaggaatttttggcccatggcctcagcaatatagtttcttcatttttcttctgcataccaagtgctgctgccatgggaaggacggctggcctgtacagcacaggagcgaagacacaggtggcttgtctaatatcttgcattttcgtccttatagtcatctatgcaataggacctttgctttactggctgcccatgtgtgtccttgcaagcattattgttgtgggactgaagggaatgctaatacagttccgagatttaaaaaaatattggaatgtggataaaatcgattggggaatatgggtcagtacatatgtatttacaatatgctttgctgccaatgtgggactgctgtttggtgttgtttgtaccatagctatagtgataggacgcttcccaagagcaatgactgtaagtataaaaaatatgaaagaaatggaatttaaagtgaagacagaaatggacagtgaaaccctgcagcaggtgaaaattatctcaataaacaacccgcttgttttcctgaatgcaaaaaaattttatactgatttaatgaacatgatccaaaaggaaaatgcctgtaatcagccacttgatgatatcagcaagtgtgaacaaaacacattgcttaattccctatccaatggcaactgcaatgaagaagcttcacagtcctgccctaatgagaagtgttatttaatcctggattgcagtggatttaccttttttgactattctggagtctccatgcttgttgaggtttacatggactgtaaaggcaggagtgtggatgtattgttagcccattgtacagcttccttgataaaagcaatgacgcatgtggatcctagacagcgccttatctatgattgagtgtccgtgtaaataaattcctacttagacttaaagaa

SEQ ID NO: 322096 - DNA, 3741 bp, Homo sapiens
ttctgtttcttgtttctctttcagggaatatgggtcagtacatatgtatttacaatatgctttgctgccaatgtgggactgctgtttggtgttgtttgtaccatagctatagtgataggacgcttcccaagagcaatgactgtaagtataaaaaatatgaaagaaatggaatttaaagtgaagacagaaatggacagtgaaaccctgcagcaggtgaaaattatctcaataaacaacccgcttgttttcctgaatgcaaaaaaattttatactgatttaatgaacatgatccaaaaggaaaatgcctgtaatcagccacttgatgatatcagcaagtgtgaacaaaacacattgcttaattccctatccaatggcaactgcaatgaagaagcttcacagtcctgccctaatgagaagtgttatttaatcctggattgcagtggatttaccttttttgactattctggagtctccatgcttgttgaggtttacatggactgtaaaggcaggagtgtggatgtattgttagcccattgtacagcttccttgataaaagcaatgacgtattatggaaacctagactcagagaaaccaattttttttgaatcggtatctgctgcaataagtcatatccattcaaataagaatttgagcaaactcagtgaccacagtgaagtctgagacccttttgtcacagtacagctcttgtctttaccaactgcctgaagaggccatatgctggcattttgcacaactttttggttgtttagatcctacagatgacctctgctacaataagtacgatgtgacttagtaactgcatagcagttggaaagaactgccaacttttttttctcatttttgttagtaagaagattcgcttagttattttatgtaaaaatcagtatgtgtttagttttagtgtactgaagggtaaacatggttttattttattttaccatattattttgtgttgttttatttctattgtgctgtaagttgatgtttaaaattgagaaatacttttgtcataggtaatttggaacatttacaagccatttgtaaaattttaagataatctgtaactaatacataaaaacaacttagcaaatgtgccattttcacacaacttctctctgtataggcctctgaaatatcaataaggctaaatattactttacacagtaagatgtgaaattcacaaaaagtaaaccaaacaaaacgaatgaaaaactggaaataattcgtttccatatctttccatacatccatttctgaagtattcaggaatgttttcataatcgaaagaaacgggtatccaaataaaaccaagttcttgacattggtctgttttgctgtgaatattggaaatgcttaggatcttcagacccaatagctctaattttaacatttctacccaataagaggctctgttttccactgaagctttgttggagaaagagaatatgaaaattacacattttataatttttagatgagaaaataccactagcagaatagctttgtgctattccagtataagatgaactgtaataatttttgacttccctatttcagagatagtcaatataatatgtttatctatatccatatggatggataggtaggtagatcttcatagatttttttttcttttgttagaggagagcttgatgtgattatcttcaaacccaccaaaccaacaggataattgacaaataaacgccataggctaggctgaactgtatgttactgttttcatgcttatacatatattttcaatcacatacaagtacatagaatttcacattttaatttagcaaattgatttacctaggaaaaaattatcaccttcaaagataggcatagacacataattatgcttaagcttttaacagcattttaaccgctctaaaaattaccagagtaagaaaaagctaggtactttaaagtgagtttgagaaacaagttgaaactaaaattaaaataccagccatttaggtgctttctctggcatctataaaagtaaattctagtgcctgccaagtgatggattataatggtctctagcaaatgtgtggtaaacattcatatggccattaattttaacattaaatcgtaggtagggcaatgtagtaaaatgaaagagaattaagaaaggttttgaattcttataacatatccagccatttcaattttgattgaaatgaactacaaagaatagtgtttgtccctatggtagcctcagtctctttatcactaacttggattgaaatgagtgaggccaactcacattcccatcaaacactcttccaaggaaaagcagaagtaataattggaggtaaagtttccttagagaaaataattttattctgctttgtccaattaaattattccaatggcggatggtaatattcaccatctctaattcattggtcactggtaggtaagcatgagttaaggaaagtcaaaaatgaaaatatattttgctgtgtataaattgatattttgctatgcaactcctgtaattgaatttgtataatgcaggcactttctaatttattagagattatggatcagttctgacattaaaatcatagttaattgatggatggtttttatagtttgttgataaagtggacacagtattgtctgagcagttatattttaatgcatttcagtgtttatagtagaagtttagtggataaaactttaagtccaataacttgggggtcaaatgctaatgttttattcaatgtaaaggaagaccaaaccatgtaccttatgaagacctttgttttaagacttccacacaccaaggctacaatgactgttaacctggaggaagtctctggtatggagttctgagagcttaagagctaaacatgagtttagacacacaagattctaaaatgcaaatgtttattttgaagcaggcattgacaacacaaaaactgtgtagtggtcttgatgctggattgtttctagagtcacaatgaattatttttatgagattaccttatttttatatatgacaaactacttctataatgcttattatggtaaaataaaattggaaaaaattaaaactgacctataagagtgttaaggacctaatagagtgacatatataaattaagcataaaatatgtaaccaggaaaagactgttaacattacatttatgcaaattaaatgcccttaaatttcaccatttgtctttcattttaaaggttatttgctcccgattatatgattcaagtgttataagttttagcttgaactactttgcagtaatttatttgacagatctctattctataaatgtgtaatgtgatgaagaaagagatctttcttttttaatgaaaacattaatgtgttaataccctgtatggataatgcttgacatttagtggtttccaaaatatattagtatattgttgaacatacattatgccttagaaatgcacattctgtattttgtgggatgataatctaattcagtatagaatatgctgtttggcaatgagtttgtggccagatttcaaatagggagttaagtggtactttcacaatccaaagatttttagttaaaaatcatgtagtctaatatgctgcagttatttttttatatttttcaatgcatttaattatcttttttataattctttgtactaactcagcatgtaacaaccaatttacatggaaataaatcgaaatatgataactattatgcttaaaaa

SEQ ID NO: 322097 - DNA, 1148 bp, Homo sapiens
ttctgtttcttgtttctctttcagggaatatgggtcagtacatatgtatttacaatatgctttgctgccaatgtgggactgctgtttggtgttgtttgtaccatagctatagtgataggacgcttcccaagagcaatgactgtaagtataaaaaatatgaaagaaatggaatttaaagtgaagacagaaatggacagtgaaaccctgcagcaggtgaaaattatctcaataaacaacccgcttgttttcctgaatgcaaaaaaattttatactgatttaatgaacatgatccaaaaggaaaatgcctgtaatcagccacttgatgatatcagcaagtgtgaacaaaacacattgcttaattccctatccaatggcaactgcaatgaagaagcttcacagtcctgccctaatgagaagtgttatttaatcctggattgcagtggatttaccttttttgactattctggagtctccatgcttgttgaggtttacatggactgtaaaggcaggagtgtggatgtattgttagcccattgtacagcttccttgataaaagcaatgacgtattatggaaacctagactcagagaaaccaattttttttgaatcggtatctgctgcaataagtcatatccattcaaataaggccagttataaactgttgtttgataacttggatcttccaacaatgccaccgctctgaggattgggtggttgcctatcatttgcaaactgcttacttgtacaacaaatgcttcttccaggatctactgtcctggggacttgaatccacctttctcaaatataaaaactctaaatatggccttttaagttttttctgctctgatatcttgcctctaagcttatattgccatctttggaaatactatttgtagaatctagtgctcacatgatctgaagtgtcaaagttattttacaaatgctgggcttatggtttagttttacaactgttcttagagctttaatttcctgcaatttttccttgagttttgaattgttttgcctttcctcacccctagaataacatttggtgcctcgcagagtcatccctattgtatacaatcagaacagtatgtatttacaaaataataataacactattattattaaatctaacatatattgagt

SEQ ID NO: 322098 - DNA, 224 bp, Homo sapiens
ccagtggagtaacaaaatgttgaaaagttccccaagtcgttaaaagaggatcatatataagtgtgggggaagtatagatagatagacaggtagatggatagatagataaatggacagatggataaatagatagatagatagatagatagatagatagatagatagatagatagatagatagaactggatgagtcaagcattacattttagttatatggaaagtt

SEQ ID NO: 322099 - DNA, 417 bp, Homo sapiens
caacaacaaatgcatgctgaaaaaataatgaatgcattgcagcacattgttagcagtcgttattatgaagaaaatggtttgcctctgtctttcgcaaatagaacgtacaacacgctctggcccagccacactcagtatcatcccatagcggaaaagaaggtgaaaaattctgaaaaaatatttgagtgaggaatgcaaactttacagagggtcttttggttggacgtcagtggcacatccacatgcaacacagggaagttggatgtgtacccagacatgagaaatacaaggaaacaatgccacaggggactcctcagtttggtgaggtggggcaagaattcccctgctcctaacggcgcaaaccctatattaaaagtagacaagccaagtgaaccttttcactcaaatccgatctga

SEQ ID NO: 322100 - DNA, 283 bp, Homo sapiens
tgcagatatcaagtaggcaaataaatgtttggagctcagacctagagaggaagaggatcagggatcagcagttctgaaaagatctctaacttaccagcagactgtgatcgccttgtgggaagagacttgcgtttctgaattccctgttgtgtgtttgttttgagagaaaacagagcatatttgtatgctggcagaagtgacagaagtgatagaaaattctagaaagtaaagatgcaggaattaagagtgagataattaaagggtcaacttccttgagaaggtg

SEQ ID NO: 322101 - DNA, 159 bp, Homo sapiens
tatgtagcccaaagtaaatgctcatgattaggacacaggaacactgaaaaatgacaggtagagaagtttcatgaagaagtggtgcacactgggagacacccacagtatttctttcaggggtcctcactctggtccgttactaatcacaaccaacaggac

SEQ ID NO: 322102 - DNA, 360 bp, Homo sapiens
gatgcatactagctctacatattcacaaatatatgcaaaatagtcatttttaaagtaattataaaaaatttgttgttggccgggcgcggtggctcacgcctgtaatcccagcactttgggaggccgaggcaggcggatcacctgaagtcaggagttggagaacagcctggccaacatggtgaaacccgtctttactgaaaatacaaaaaattagctgggcaaggtggtgggcacctgtagtcccagctattcaggaggctgaggcaggagaattgcttcaacccaggaggcagaggttgcagtgagctgagatcgtgccactgcactccagcctgggtgacagagcaagactccatgtcg

SEQ ID NO: 322103 - DNA, 637 bp, Homo sapiens
caagttatccagaagacctagctagtatcattgatgaaggtggctacactaaacaatagattttcaatgaagattacagtggaagaagatgtgatttaggtcttttctaactagagagaagttaacacctggtttcaaggcctcaaaagacaggctgacacctttgttaggaactaataaggctggtgactataagctgaaggcaatgctcatttatcattctgaaaatcccacagccctaaagaggtatgctaaatccactctgcctgtgctttataaatgggataacaaagcctgtgtgatagcccaactgttgacatcatggtttactgaatacttttaagtctatatggatagctactactcagaaaaagagattcctttcaatatactattcctcattaaatatacatttggtcattcaagagctctgacagatgtaaaaagagattaaatttgtcttcatgcctaacacagtatctattctgcggctcatggatcaagaagtaattttgactttaagtcttattatttaagaaatacatttcatttcataagtctatatataactaacacagacagcaattcctctaataaagcaaaggaaagggaaaactttctgaaaaggattcagtca

SEQ ID NO: 322104 - DNA, 200 bp, Homo sapiens
gcggccgcctactactactactactgctcgaattcaagcttctaacgatgtacggggacatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 322105 - DNA, 3209 bp, Homo sapiens
  misc_feature (2716)..(2716): n is a, c, g, or t
  misc_feature (2734)..(2734): n is a, c, g, or t
  misc_feature (2750)..(2750): n is a, c, g, or t
  misc_feature (2761)..(2761): n is a, c, g, or t
  misc_feature (2765)..(2765): n is a, c, g, or t
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggcaaaaaaaaaaaaaaaaaaaaaaaaaaaaaaaaaaaaaaanaaaaaaaaaaaaaaaaanaaaaaaaaaaaaaaanaaaaaaaaaanaaanaaacccctgggggggccccgagccccctaggcccttttggggggcgtattacaataaatgggcggccgttttacaacaccgggcctgcgaaaaccccgggggaaccccccaaaaatagctggttgcacaacccccttttttcggcgggggtaatattcaaaaggccccccccaatgggcgttttcaccaatagtgcacccttatgggcgattggcgaattttaggcggcaatattttgttgaaaaccgccccaaaatttttgaaaacccactccatcttttacccaaaagggcgaatatttgtgaaatccctttttatatcataaaaatcccccgcgaaaggctggagggttgtcccaatttttgacacgaagttccctctttatgaaacggggtctccttacttctaaaggcggaaaaggtttttttgggcccaggaggccct

SEQ ID NO: 322106 - DNA, 2676 bp, Homo sapiens
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 322107 - DNA, 2544 bp, Homo sapiens
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 322108 - DNA, 2661 bp, Homo sapiens
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaatttcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 322109 - DNA, 2603 bp, Homo sapiens
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 322110 - DNA, 1488 bp, Homo sapiens
gcgaaatgagagccagttccctgtgtgcacgaacaggtggctactgacagtcaataagttcagtgcatcgagaggaagctgtgtattgataatcactgcgtacaaaggatgaggtgtcttcgcgagtaacgtccagccaagtatcttatatagaaccgtcagtcaaacttgagacgcttgttgccaaaacatgctctgtggaggtgactggagtttaatggcatagagtctctgattctattaagggaggattgagcaagaatacgttgatacgaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 322111 - DNA, 2443 bp, Homo sapiens
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 322112 - DNA, 5347 bp, Homo sapiens
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggtaagtatgatggagcttatatcctgctagtaggtaggtctttcagccctttctactccatctcctgactcagactctaaagtgcaaagtggtcagactcacaaaactcagtgttccccaaacagttgacagacgtctgtggagcaagctgtgtgccacacactgtcttgtgtgctggaagtgcccagaagagtaagaaagttcccacgctcagggcatccacagatgtgtaaaagagtcagtgcagccagagatccaaggtgccacacctggcttgtggtcaggggaggatgaaggcaggagcagccatatctctctgggccatcagggagagcaccacagaggaagcagctcttgagcttagtacccaggcggaaagtaggagtgttccaggaggagggaggggtggcatgaacaaaggcctgaccttttacattccatttatttgcccatgctcttctttttgcctgacctgtccttacctgacaaatgacttgtctttcaaaattagctcagatattatctccaaggacctctttccaagttgctggggagctgtaaccagtccctctcctgagccacgtactggactgccagcttagtgcctgttgtgttatgttagtcataatatgcctctctctcttccctgttaggctgtgagtgtctcaaagcatcaaagcacatcttatttgtctttatgtttccagaatttagcacagtatctgatgtttttaggtattctgtaaacaactgttggactaaattgcatttgtctaaagtgtgtttatgccttgtatagattttcctagtccccaaattgtcaagggtcctcttaggctcttcagctgcagtgttgaatggacttgatatagtgagctttctgtcaacttgatatatactgagctttccattaataaaaaagaaactaagacgtttctttccaatgtaacttaattttttctgttgtctcagtctggtttgttttaggttttattcctgtggttctctggtaatttccaagattggataaaacaactaaatctcactcccacttgcttttttaaaatgctttttctacgtaaccaagcacattttagttgatgccatgacaagtgagaaatttgcatctgtgatgtttcagctgaatacacaccattggcactgacatttccactgagcctgctccagaaatctggacagaacagaggccaccagtataggagctggctgtcatcctccttcccacccactgcacatgccatgcacagctttggcaggctgttcagacttcacacatcagctgccttcattctctcaatttatctttgtactgcccattttgggggcaaggtgtcagcttattttccttcagcacctgttaacacccaaaggaattaaagataaaaatagcagacctttctattaatgtgctaatggacttcccttatgctcagaggatttccagaggatttgactggaaatcgttaaatgcagtggaaattctaatttcagtgtttggctccagcagcaagcgtacatgaagaacacctaggggccagattaaaatcatctttatgtatggactctctgaagggtgaagattcatgttttctctattgttagtaaataaaaagtgattttctttgttaacttacaaaggagaaaggtggcgagtttctcctgtactactggtccgtatttttaaatgatgtttgttcaatatattgtgttctgagacacctgacctttaaggcatcagacagaaggctttgtgccatatagaaaggaaatatttagtttgtccagacagaggaaggggaaaaaaaggaattagtcacccttaccaggaggtacagaaaaaaacagagctccttacattcccatggatgatgtagaagagctcctagcttcttaatgtactgttaaaaacctaggactaccagaagctttttttttaaatctagcccttccttattttaagcattcagttaaaatactgagatcatggcagggaaattatgctacgttcccaattttgctgtttctcttaagttttcctgggattttgttacatggtaaatttagcaaacatcatgtgatctaatcccaggcagttgttaaatggaacaaattgtggctctgcacttcagattggtttgatttttcttgttgagccaaagagtaacacaagcacctcattctcagcaggctctgtgccctctgtagggataagtcctttatcattggtggcatttcattcacatgcatgttggattgaatcccaagagtttctgtgttttttgtgtatgctttttctctcagcagcctgctaaaaatttcagttcatatttcccacctacatggaatgttttaaaacataatcagtgtagtatgaacccactttgaggaggacaggtgaaaacaggctcaatttctatgagaaatttgggaaagctgctcctttctgctgatctgcaaaaagtgtggcctttacaaattcttccttttgaagaatgtggttccaaatctattccagaaagccaagtttcatattttagagaaagtcatgtgacctggataaataaatgatctcagggctagatagtgtagaaacatcagcaatcttaaaacaaaaaaacaccaagtaatgaattttctttcttcttcacaggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 322113 - DNA, 3022 bp, Homo sapiens
  misc_feature (2529)..(2529): n is a, c, g, or t
  misc_feature (2547)..(2547): n is a, c, g, or t
  misc_feature (2563)..(2563): n is a, c, g, or t
  misc_feature (2574)..(2574): n is a, c, g, or t
  misc_feature (2578)..(2578): n is a, c, g, or t
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggcaaaaaaaaaaaaaaaaaaaaaaaaaaaaaaaaaaaaaaanaaaaaaaaaaaaaaaaanaaaaaaaaaaaaaaanaaaaaaaaaanaaanaaacccctgggggggccccgagccccctaggcccttttggggggcgtattacaataaatgggcggccgttttacaacaccgggcctgcgaaaaccccgggggaaccccccaaaaatagctggttgcacaacccccttttttcggcgggggtaatattcaaaaggccccccccaatgggcgttttcaccaatagtgcacccttatgggcgattggcgaattttaggcggcaatattttgttgaaaaccgccccaaaatttttgaaaacccactccatcttttacccaaaagggcgaatatttgtgaaatccctttttatatcataaaaatcccccgcgaaaggctggagggttgtcccaatttttgacacgaagttccctctttatgaaacggggtctccttacttctaaaggcggaaaaggtttttttgggcccaggaggccct

SEQ ID NO: 322114 - DNA, 975 bp, Homo sapiens
taccaaaaaataattgcttttccaggccgttttccaagggccccagggggcaaaacggctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 322115 - DNA, 1733 bp, Homo sapiens
  misc_feature (1689)..(1689): n is a, c, g, or t
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggnaaattgccagcaacgctaacctcctaagaactccccttggctca

SEQ ID NO: 322116 - DNA, 1652 bp, Homo sapiens
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggacctaaatggacaatggacctaaatgga

SEQ ID NO: 322117 - DNA, 714 bp, Homo sapiens
aaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggcctctcttgtttttactgtgtatgttcttgctcagggctctctagataatgcagaataaagagaaacgttgggggatttataaactgaatgtta

SEQ ID NO: 322118 - DNA, 2888 bp, Homo sapiens
  misc_feature (2716)..(2716): n is a, c, g, or t
  misc_feature (2734)..(2734): n is a, c, g, or t
  misc_feature (2750)..(2750): n is a, c, g, or t
  misc_feature (2761)..(2761): n is a, c, g, or t
  misc_feature (2765)..(2765): n is a, c, g, or t
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggcaaaaaaaaaaaaaaaaaaaaaaaaaaaaaaaaaaaaaaanaaaaaaaaaaaaaaaaanaaaaaaaaaaaaaaanaaaaaaaaaanaaanaaaaaaagagagggggcgcagcaccgcaagaaatatgacccccgcgcgggggcgaccacatcaagagcacacacgactctgtttcacaagtaaagggacaccccaatagagaggagccataca

SEQ ID NO: 322119 - DNA, 2612 bp, Homo sapiens
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 322120 - DNA, 2622 bp, Homo sapiens
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaatatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 322121 - DNA, 2528 bp, Homo sapiens
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtcttttccttctggccttcttgatcacatggttctttgcacttcgcggtgtatcgccacttcatgtgctgtggatataccgttattacacgccttacgcgtgtgatatcgtcgagccagtagatcctgtgatataccagatctcactaatcagggacctgcatttgcatgcactcgacatgccagatactgaccgagcgcagcgaatcagtgagtcgagataacaacctg

SEQ ID NO: 322122 - DNA, 2546 bp, Homo sapiens
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 322123 - DNA, 3152 bp, Homo sapiens
  misc_feature (2659)..(2659): n is a, c, g, or t
  misc_feature (2677)..(2677): n is a, c, g, or t
  misc_feature (2693)..(2693): n is a, c, g, or t
  misc_feature (2704)..(2704): n is a, c, g, or t
  misc_feature (2708)..(2708): n is a, c, g, or t
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctacttttactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggcaaaaaaaaaaaaaaaaaaaaaaaaaaaaaaaaaaaaaaanaaaaaaaaaaaaaaaaanaaaaaaaaaaaaaaanaaaaaaaaaanaaanaaacccctgggggggccccgagccccctaggcccttttggggggcgtattacaataaatgggcggccgttttacaacaccgggcctgcgaaaaccccgggggaaccccccaaaaatagctggttgcacaacccccttttttcggcgggggtaatattcaaaaggccccccccaatgggcgttttcaccaatagtgcacccttatgggcgattggcgaattttaggcggcaatattttgttgaaaaccgccccaaaatttttgaaaacccactccatcttttacccaaaagggcgaatatttgtgaaatccctttttatatcataaaaatcccccgcgaaaggctggagggttgtcccaatttttgacacgaagttccctctttatgaaacggggtctccttacttctaaaggcggaaaaggtttttttgggcccaggaggccct

SEQ ID NO: 322124 - DNA, 2616 bp, Homo sapiens
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcaaattgaaaatcactggcaacatgggtctcgctatgaagttacgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggc

SEQ ID NO: 322125 - DNA, 1715 bp, Homo sapiens
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggtcttgctcagtgtgcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagaggaaggggaacagtttgtgaagaaaatcggtggtatttttgccttcaaggtgaaagatggccctgggggtaaagaggccacctgggtggtggatgtgaagaatggcaaaggatcagtgcttcctaactcagataagaaggctgactgcacaatcacaatggctgactcagacttcctggctttaatgactggtaaaatgaatcctcagtcggccttctttcaaggcttgtcactggccatgggtctcgcttg

SEQ ID NO: 322126 - DNA, 2181 bp, Homo sapiens
agcggacgcgcctgtgttgccgcccgcggccctggcttcgggcttcagggagctctggtgcagtctccgcctgtcagtgccggcagtcgtccgcggcgcccgccccggtcccgcactggtgcagccatgtcctcttccccgtgggagcctgcgaccctgcgccgggtgttcgtggtgggggttggcatgaccaagtttgtgaagcctggagctgagaattcaagagactaccctgacttggcagaagaagcaggcaagaaggctttagctgatgcacagatcccttattcagcagtggaccaggcatgtgttggctatgtttttggtgactctacctgtgggcagagggctatctatcacagtttgggaatgactggaattcctataatcaatgtcaacaataactgtgctactggttctactgctttgtttatggcccgccagctgattcagggtggtgtggcagaatgtgtcttggctcttgggtttgagaagatgagtaagggaagccttggaataaaattttcagatagaaccattcccactgataagcatgttgacctcctgatcaataagtatggattgtctgctcacccagttgctcctcagatgtttgggtatgctggaaaagaacatatggaaaaatatggaacaaaaattgaacactttgcaaaaattggatggaaaaatcataaacattcagttaataacccgtattcccagttccaagatgaatacagtttagatgaagtgatggcatctaaagaagtttttgattttttgactatcttacaatgttgtcccacttcagatggtgctgcagcagcaattttggccagtgaagcatttgtacagaagtatggcctgcaatccaaagctgtggaaattttggcacaagaaatgatgactgatttgccaagctcgtttgaagaaaaaagcattattaaaatggttggctttgatatgagtaaagaagctgcaagaaaatgctatgagaaatctggcctgacaccaaatgatattgacgtaatagaacttcacgattgcttttctaccaacgaactccttacttatgaagcactgggactctgtccagaaggacaaggtgcaacgctggttgatagaggagataatacatatggaggaaagtgggtcataaatcctagtggtggactgatttcaaagggacacccactaggcgctacaggaggacattcctgctcttgaaatttcctgataacccggacaagttcatggaaagcttgatctacattcatcctaatctttgctgatgcctccatgtatgttaccttaagttgccgtgctaactgccgtccttcttcctgtgttacctgtctttgatgatccagatctgctttattaccaattaaaatcattgggaactcatcacgatcctttactctgagaatctgtctttgaaacttatagatttcttcaaaactgcctctatctgtgactgaaaagaccaacaggaagccctcgccagtcctcatatactgttctctcatggctccaagctcttcttgtcctgctgtatccaaaatatctagccgggctgctctgtcatctatcacacactgctttgtgtaagaatcttcattggttggatcataatccgttacaaaataggactcccaacttaggaaacaaaacatttgtaatatgattgaagactcctgcatgcctcctcaataatattcccctctctcctcccccagcaccaagaggtaatcaatatcctgaaattgggtatctgtcattctcatgcatttatacaacattagtaatcatatgatagtattcctaagctatgttttggagaggacaccactgcaaatcttcagccctatactagcttttatcggtagccatcaattgcagttttaatagaaatacaaatacatcaagtgtctgttctttaatttgtaaagaaaatttgttttctagcgtgacaccctcaaggtaccgtatctgtatgtaaatgttgtgcccaatgctacacagacattattttaaaactattttctgcctttggtaaatagactaaactgttttctttattcctcaaaagaattagatcatacttcagtgttgattttgttgctaatgggacatggagatgtctggatgataataaatattcctgtggtatggtcactg

SEQ ID NO: 322127 - DNA, 1564 bp, Homo sapiens
agcgggctggacctcgtcctgccctggccccctcgccacccctcacaccgcctccctgggctggggctgggactgcgggctggcctcttgggtgggggagtcggagtctgcgccccgctccacgtgtcagccctcaggacacgtcagagcccgaggagaccccgggtcccaccccggcctccacccggcggcccgcctgccgttcctcgccacgtgtcaccatcgctcctcatccctgggacccctaggcgggatggggagaccctcctcacccagggcggcttggggtacgttttccccaccccagagaacccaggtccccgactgtcactccgcccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccagggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccgagcacgaacttccaggagccggtgcagccgctgacacagcagcaggtggcgcagatgcagctgaagtactacaactccgacgtgcaccgcgccgcctttgtgctgcccgagtttgcccgcaaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagcaaaaaaaaaaaaacaaaaaaaacaaacttttggggcgcgccggccagaaaaagttttaaaccccatcgtgtggggcggggcccagggttaggacacgggccaacgggcccaggaaccgggccgacagggtgggttccccaaaaaagccgcgggcccggggttgaacacccagggtcggggctcgggtcaccgggccagggcacccgg

SEQ ID NO: 322128 - DNA, 1059 bp, Homo sapiens
gactctcgaggactttgcaggggtggcgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccagggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccgagcacgaacttccaggagccggtgcagccgctgacacagcagcaggtggcgcagatgcagctgaagtactacaactccgacgtgcaccgcgccgcctttgtgctgcccgagtttgcccgcaaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagcaaaaaaaaaaaaacaaaaaaaacaaacttttggggcgcgccggccagaaaaagttttaaaccccatcgtgtggggcggggcccagggttaggacacgggccaacgggcccaggaaccgggccgacagggtgggttccccaaaaaagccgcgggcccggggttgaacacccagggtcggggctcgggtcaccgggccagggcacccgg

SEQ ID NO: 322129 - DNA, 1325 bp, Homo sapiens
cggcggagctggtcccgttgtgctgcggcgccgcgcggcctgcagtcccgggcccgcgccccgcgccgcccgcccgcccgccatggagcccggccccgacggccccgccgcctccggccccgccgccatccgcgagggctggttccgcgagacctgcagcctgtggcccggccaggccctgtcgctgcaggtggagcagctgctccaccaccggcgctcgcgctaccaggacatcctcgtcttccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccaggagcacgaacttccaggagccggtgcagccgctgacacagcagcaggtggcgcagatgcagctgaagtactacaactccgacgtgcaccgcgccgcctttgtgctgcccgagtttgcccgcaaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagcaaaaaaaaaaaaacaaaaaaaacaaacttttggggcgcgccggccagaaaaagttttaaaccccatcgtgtggggcggggcccagggttaggacacgggccaacgggcccaggaaccgggccgacagggtgggttccccaaaaaagccgcgggcccggggttgaacacccagggtcggggctcgggtcaccgggccagggcacccgg

SEQ ID NO: 322130 - DNA, 701 bp, Homo sapiens
gcggccgcctactactactactgctcgaattcaagcttctaacgatgtacggggacatgctgtgcagcaagaacccgagcacgaacttccaggagccggtgcagccgctgacacagcagcaggtggcgcagatgcagctgaagtactacaactccgacgtgcaccgcgccgcctttgtgctgcccgagtttgcccgcaaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagcaaaaaaaaaaaaacaaaaaaaacaaacttttggggcgcgccggccagaaaaagttttaaaccccatcgtgtggggcggggcccagggttaggacacgggccaacgggcccaggaaccgggccgacagggtgggttccccaaaaaagccgcgggcccggggttgaacacccagggtcggggctcgggtcaccgggccagggcacccgg

SEQ ID NO: 322131 - DNA, 1471 bp, Homo sapiens
cggcggagctggtcccgttgtgctgcggcgccgcgcggcctgcagtcccgggcccgcgccccgcgccgcccgcccgcccgccatggagcccggccccgacggccccgccgcctccggccccgccgccatccgcgagggctggttccgcgagacctgcagcctgtggcccggccaggccctgtcgctgcaggtggagcagctgctccaccaccggcgctcgcgctaccaggacatcctcgtcttccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccagggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccgagcacgaacttccaggagccggtgcagccgctgacacagcagcaggtggcgcagatgcagctgaagtactacaactccgacgtgcaccgcgccgcctttgtgctgcccgagtttgcccgcaaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagcaaaaaaaaaaaaacaaaaaaaacaaacttttggggcgcgccggccagaaaaagttttaaaccccatcgtgtggggcggggcccagggttaggacacgggccaacgggcccaggaaccgggccgacagggtgggttccccaaaaaagccgcgggcccggggttgaacacccagggtcggggctcgggtcaccgggccagggcacccgg

SEQ ID NO: 322132 - DNA, 1386 bp, Homo sapiens
cggcggagctggtcccgttgtgctgcggcgccgcgcggcctgcagtcccgggcccgcgccccgcgccgcccgcccgcccgccatggagcccggccccgacggccccgccgcctccggccccgccgccatccgcgagggctggttccgcgagacctgcagcctgtggcccggccaggccctgtcgctgcaggtggagcagctgctccaccaccggcgctcgcgctaccaggacatcctcgtcttccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccagggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccgagcacgaacttccaggagccggtgcagccgctgacacagcagcaggtggcgcagatgcagctgaagtactacaactccgacgtgcaccgcgccgcctttgtgctgcccgagtttgcccgcaaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagcaaaaaaaaaaaaagaaaccggggcatatgcggggggcgaaaaaggtataagtggcatggtctaagtgtccggccacgtttgtaacggggatgcggccataggggatacagacgcacaaggag

SEQ ID NO: 322133 - DNA, 1301 bp, Homo sapiens
cggcggagctggtcccgttgtgctgcggcgccgcgcggcctgcagtcccgggcccgcgccccgcgccgcccgcccgcccgccatggagcccggccccgacggccccgccgcctccggccccgccgccatccgcgagggctggttccgcgagacctgcagcctgtggcccggccaggccctgtcgctgcaggtggagcagctgctccaccaccggcgctcgcgctaccaggacatcctcgtcttccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccaggcagccgctgacacagcagcaggtggcgcagatgcagctgaagtactacaactccgacgtgcaccgcgccgcctttgtgctgcccgagtttgcccgcaaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagcaaaaaaaaaaaaacaaaaaaaacaaacttttggggcgcgccggccagaaaaagttttaaaccccatcgtgtggggcggggcccagggttaggacacgggccaacgggcccaggaaccgggccgacagggtgggttccccaaaaaagccgcgggcccggggttgaacacccagggtcggggctcgggtcaccgggccagggcacccgg

SEQ ID NO: 322134 - DNA, 1547 bp, Homo sapiens
cggcggagctggtcccgttgtgctgcggcgccgcgcggcctgcagtcccgggcccgcgccccgcgccgcccgcccgcccgccatggagcccggccccgacggccccgccgcctccggccccgccgccatccgcgagggctggttccgcgagacctgcagcctgtggcccggccaggccctgtcgctgcaggtggagcagctgctccaccaccggcgctcgcgctaccaggacatcctcgtcttccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccagggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccgagcacgaacttccaggagccggtgcagccgctgacacagcagcaggtggcgcagatgcagctgaagtactacaactccgacgtgcaccgcgccgcctttgtgctgcccgagtttgcccgcaaggtgggtggcctgcggggctgggtggtgggacccagggacccagagcgccctcctgactggcctcatgtccctccaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagcaaaaaaaaaaaaacaaaaaaaacaaacttttggggcgcgccggccagaaaaagttttaaaccccatcgtgtggggcggggcccagggttaggacacgggccaacgggcccaggaaccgggccgacagggtgggttccccaaaaaagccgcgggcccggggttgaacacccagggtcggggctcgggtcaccgggccagggcacccgg

SEQ ID NO: 322135 - DNA, 1197 bp, Homo sapiens
cggcggagctggtcccgttgtgctgcggcgccgcgcggcctgcagtcccgggcccgcgccccgcgccgcccgcccgcccgccatggagcccggccccgacggccccgccgcctccggccccgccgccatccgcgagggctggttccgcgagacctgcagcctgtggcccggccaggccctgtcgctgcaggtggagcagctgctccaccaccggcgctcgcgctaccaggacatcctcgtcttccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccagggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccggtgagatgggggtgtctgggggtgggggttggggggaaggtgggcataaatagagatccctgcccctgccgggcgcggtggctcacacctgtaatcccagcactttgggaggctgaggcgggcagatcacaaggtcaggagatcgagaccatcttggctaacacggtgaaaccccgtctctactaaaaatacaaaaaaattagccaggcatggcagcgcgcgcctgtagtcccagctgctggggaggctgaggcaggagaatggcgtgaacccgggaggcggagcttgcagtgagccgagattgcgccactacattccagcctgggtaacagaggaagattccgactcaa

SEQ ID NO: 322136 - DNA, 510 bp, Homo sapiens
caaacagtgaaagaagagacttattgcaaagcaaaaagtacacactcaagaaaggggagttcgggcatacccgagagagaacaatgggttctggggtttcatcttgattggtttctctaaccaaggagtggaatagtcatgaaaattcctgggtaaaggtggagatttctcggaactgtggtgccatccatttttacatcacatattggtctcagaactgtcatggcactggtgggtgtgtgatttagtatgttaatgagcatataatgagggcctcggtaaaacctacatcaaatccagcaccacattgggtccagtcagtcttagccagcttggtccacaccctggtttttcagcgtcttatcagcccatagcctcaagtcatgtaaatctgctgcctagaatttgttaccctgcggccaccctgtattattcctgcctcaaatctacttgtaaatattcaaatggtctttgacttgggaattccaactttacttacttcacagtgtt

SEQ ID NO: 322137 - DNA, 698 bp, Homo sapiens
agaagatgaggatactcataacaatagattttattattaaaatatagactaatgtttcattactgtgttattcactagtgtattttttaaagcagggatatactggtcatgactactgaacataaatgaaccaaggagttcattactgagggtttaagtggaatatttttcagtctcctggagtagccttttccacttattttgttttccaaatattgcctttgtgtatatatgagttactgaagctggctatcaagggatttcagcaatcgagagtcccttcaagattgtaatcactgccatctggatctcaaagatcatccagtcgcctggttcccagcctgaccttcccattggagtcacctggggactaagttccacctgcagagcttctcatttaattggcatgggctgtgacctggacagtgggatatttttaaacctgcccagatgaatccaatatgcagcagtttgagaaccactcaactagttcaactccatgaatttaaaaataaagcaactgaagccaaaagaggttttgataacagattgaacagaagagtttgagcagcttttgataaacactaagcatggcactttataaagtttttataatccatttttgcattttctgaaaacacaggtcaccccaggctctacctgtgctgtgtttggcctgggaggggtcggcctatctg

SEQ ID NO: 322138 - DNA, 657 bp, Homo sapiens
  misc_feature (500)..(500): n is a, c, g, or t
ctttatgcacttgagcagggaagaaatccacaaggactcaccagtctcctggtctgcagagaagacagaatcaacatgagcacagcaggaaaagtaatcaaatgcaaagcagctgtgctatgggagttaaagaaacccttttccattgaggaggtggaggttgcacctcctaaggcccatgaagttcgtattaagatggtttgacactgaccttggtaggggcagtgggatagttgggcagtcctgcttgagaaccagttaaattgggttgaggagagcaccttagtatggtctgaagcccacttctttgggtgaatttagagggattccttcatcaaatcttctcatttaaatactggcccacacccatatctcaggcgtacgtcactggtgcttgatcctaagagatgattttacaggtacagcattagtatgggccaatgacaatcagcacattcactgtcaatgggatagcacctttgtacacacccttttacctnctttaagtgccaatacttcgacctaagacttgatcaggctgggtgcgggggctcatgcctcgtatcctagcacttttggaggcctaggtgggtcgaatggctgagctcagaagtttgagaccagactgggcaacattgcaaaacccccattctactt

SEQ ID NO: 322139 - DNA, 549 bp, Homo sapiens
ctttatgcacttgagcagggaagaaatccacaaggactcaccagtctcctggtctgcagagaagacagaatcaacatgagcacagcaggaaaagtaatcaaatgcaaaaaaaaaaacaaaaaaaaaaaaaaaaaaaaaaaaaaaaaaaaaaaaaaaaaaaaaaaaaaaaaaaaaaataaaaaacaaaaaaaaaaaaaaatgaaataaattatgacaacatattaaataaagaggaaaattaaaataattggtccaatattcccaatactggggcccattacaccaaagtggcagccttttaccaacgtaatgacggggaaacaactgtggtaaccaatgaaataaacgattgttaataatagcaatttgcctagcagtcaacatatcaatagagatctccctgatgaccctttaaccagttgcgtgacctattagaatcaatgcgaatgtaaaccgtgatatttgttttaaaggcccataaatattggtaaatctatgacattatttaacaaataggcccaattcattaaaaaattcttaaatttacaa

SEQ ID NO: 322140 - DNA, 3360 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccgagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatcatttactgtgtgatcttcagtaagtctctcaggctctctgagcttgttcatcctttgttttgaaaaaattactcaaccaatccattacagcttaaccaagattaaatgggatgatgttaatgaaagagcttcgccaattaagaa

SEQ ID NO: 322141 - DNA, 3306 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccgagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatcatttactgtgtgatcttcagtaagtctctcaggctctctgagcttgttcatcctttgttttgaaaaaattactcaaccaatccattacagcttaaccaagattaaatgggatgatgttaatgaaagagcttcgccaattaagaa

SEQ ID NO: 322142 - DNA, 3158 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatc

SEQ ID NO: 322143 - DNA, 2475 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccgagagttctaaatacaggaaatttcttaggaactcaaataaaatgccccacattttactaca

SEQ ID NO: 322144 - DNA, 3168 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgagttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccgagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatc

SEQ ID NO: 322145 - DNA, 1741 bp, Homo sapiens
ataaacttctgtactattatttctatgggagagacaaaataactaagaaccttcgtttatctgtgattttttttaagtcaagacactgtaaaagcatattgaagtactgtatctcttcttatcctcagttatagcagtctggaatggagcaccttttctaaactttgatttatttggaaaatcttctcttcaattctcctacttaccctagctgaatccaacaatgatactgtcttcttttcaggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccgagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatc

SEQ ID NO: 322146 - DNA, 3114 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgagttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggagaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccgagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatc

SEQ ID NO: 322147 - DNA, 1687 bp, Homo sapiens
ataaacttctgtactattatttctatgggagagacaaaataactaagaaccttcgtttatctgtgattttttttaagtcaagacactgtaaaagcatattgaagtactgtatctcttcttatcctcagttatagcagtctggaatggagcaccttttctaaactttgatttatttggaaaatcttctcttcaattctcctacttaccctagctgaatccaacaatgatactgtcttcttttcaggctttaagagtaaagaaggtatcccaaaacttgtggctgattttatggctaagaagttttcactggatgcgttaataacccatgttttaccttttgaaaaaataaatgaaggatttgacctgcttcactctgggaaaagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccgagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatc

SEQ ID NO: 322148 - DNA, 1838 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaagaaagttgtctgacagaagtttgatgagaggaatttgactcagaagactgaaatatcctttaaccttactataaaatatcttacaaaatactcattgatttcacagcattagaatcatcaaggttaagcaagacatcaacatgcaaattctgattaaaaggggtccattatgatacaattcagggaatttccacaaaaatcctatggaacagtatcttccccatttaaaagttaatatggttttacagaaaatcaatgatacaatttgaataataatacaatttgaatcacttagcactaggaatacagatatttggttttttcttctataaatttgtacttatttgctcaatgtgtttacaggtgcatgtggtcattcaatataatcaattgatttttttaattgtttaattacataaacctgtgcaactatgtccagtcctttttttgtgttaggagtgtaccacactgtaaaatatctcactatgataattcaatttaaaggttctgaggcttctctctgcattgtgtgacaaacaggctcatatcaataagactggttgatggagctagaggacgttattctaagtaaagtaactcatgaatggaacaccaaatatccaatgttctcacttaaaagtggtagctaaactatgaggacacaaaggatgagaatgatataatggactttggggactgagggaaaagggcagtaggaggaataagacataaaagactacatattgggttcagtctacactgcttgtgtgaggggtgcaccaaaatatcagaaatcaccactaaagaacttatccgtgtaaccaaaaaccatctgcaccccaaaaactattgaaattaaaaattaatcaatgaataaattttaagataaaaataatgcatgtaatttacccagcacaggtcacaatgtgcctgtcacatcataagcacctcataataagaatcttcctactattagtaccttctgtctaagtattctggtatttattttggcattgaccatgttgaacatcctacaaagttgaaaattttgacaaataaataatg

SEQ ID NO: 322149 - DNA, 1398 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtacaggattcacactcagggaacacgtgtggttcaccatccaggatttcccagcctggataaggaaaccaaggcaatgagagacgaaagggcttgcacaaggtcaccgcgcagccaggacttcaggagtttcctctttccctctctgcctgcctgacccaagcatgtatgcattcaggcactcatgtattgtacccttcaaccattatgtaccgagtatctactagaagccaggcaccaggttagagcctggagatatgtgaggatcaaaagagacacagtgcctaccagtgtggcattcatagtccagtaattctgtgttagtgttggctgaacactgtcttctgtcagggcccagatagaagtagaaacgggaggagggaa

SEQ ID NO: 322150 - DNA, 1348 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaacattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtacaggattcacactcagggaacacgtgtggttcaccatccaggatttcccagcctggataaggaaaccaaggcaatgagagacgaaagggcttgcacaaggtcaccgcgcagccaggacttcaggagtttcctctttccctctctgcctgcctgacccaagcatgtatgcattcaggcactcatgtattgtacccttcaaccattatgtaccgagtatctactagaagccaggcaccaggttagagcctggagatatgtgaggatcaaaagagacacagtgcctaccagtgtggcattcatagtccagtaattctgtgttagtgttggctgaacactgtcttctgtcagggcccagatagaagtagaaacgggaggagggaa

SEQ ID NO: 322151 - DNA, 555 bp, Homo sapiens
atggcttccctgttatgttgtcatgaggcatgtggcacaagtgtcatcgtaggggtacctcctgattcccaaaacctctcaatgaaccctatgctgctactgactggacgtacctggaagggagctattcttggtggctttaaaagtaaagaatgtgtcccaaaacttgtggctgattttatggctaagaagttttcattggatgcattaataacccatgttttaccttttgaaaaaataaatgaaggatttgacctgcttcactctgggaaaagtatccgtaccattctgatgttttgagacaatacagatgttttcccttgtggcagtcttcagcctcctctaccctacatgatctggagcaacagctgggaaatatcattaattctgctcatcacagattttatcaataaattacatttgggggctttccaaagaaatggaaattgatgtaaaattatttttcaagcaaatgtttaaaatccaaatgagaactaaataaagtgttgaacatcagctggggaattgaagccaataaaccttccttcttaacca

SEQ ID NO: 322152 - DNA, 345 bp, Homo sapiens
gcacgtagacaatcctagggtcaaggtatcaccctgttgtctacgcgccgaccaccccctagatgtatccgtaccattctgatgttttgagacaatacagatgttttcccttgtggcagtcttcagcctcctctaccctacatgatctggagcaacagctgggaaatatcattaattctgctcatcacagattttatcaataaattacatttgggggctttccaaagaaatggaaattgatgtaaaattatttttcaagcaaatgtttaaaatccaaatgagaactaaataaagtgttgaacatcagctggggaattgaagccaataaaccttccttcttaacca

SEQ ID NO: 322153 - DNA, 527 bp, Homo sapiens
cgttgcagtctggaagcagcatcttttctaaactttcatttatttggaaaatcttctcttcaattctcctacttaccctggttgaatctaacaatgataccatcttcttttcaggctttaaaagtaaagaatgtgtcccaaaacttgtggctgattttatggctaagaagttttcattggatgcattaataacccatgttttaccttttgaaaaaataaatgaaggatttgacctgcttcactctgggaaaaggtagattttttagttagttttctgttttgcttttttttctaccataggggattgtctagcagaaaatgaaaaggtggaaggatgagaaaaattagagtgccttggttcttccattaccagttcagtctttacatggagagcttgtaagagaagtttaaaacctctgtgagatgctaaaaacagttgctttgcatttcctattgtgctgaagccaaattatgttgattacagcaaatccgaatgatcagagacactcagccttctttaaaagaga

SEQ ID NO: 322154 - DNA, 902 bp, Homo sapiens
caactgaagccaaaagaggttttgataaacggttggacaaaagagtctgagtagttcttgataaacacctacgcatggcactttatgaagcttaggcactttctaacaatcatcacttaatctatttttgcattttctgaaaacacaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatggtatgtaccatgacatgccctgagatttctgcctctgcaacctggaagatgcatttaggcagcaaaatatatgttttatgtataaaggatatttttaatgatgaatggaaatttcccatcatctgtttgttatgtggcttgtttaatttttgttatgagaaatcttctcttccatcaattacccaaacctgtctcaagtcatatttcctctagaggaaaagaaaagggtttgtttttcttaactgagcaattatagatttactttattaatttttagttaaaaaatataagttcaagtaaacataaataatataaattctgttctcaaattggaatgttttatttttctcctacattcttaacaaaaatggtttaacaattttgcctatgttcttaataaatttcagatttttaacatgttagtatttggccaaaggaaatgagcaattttaggccaactgctgttttattaacaaaaatatgccctaaggaa

SEQ ID NO: 322155 - DNA, 760 bp, Homo sapiens
gaaatccacaaagactcacagtctgctggtgggcagagaagacagaaacgacatgagcacagcaggaaaaagtaagcaaaaaatatattactgttggtaatatattctcatcaatataacaaagaaaggaatacagtatttgatgaataatttaaaattcatatctaaattagaaatgatatgctgaaatatgatatgcaatatacacctcaatatgtaatgtatactgaactgcagtggaaataagctattcttaagtacctttaacaggaatgtatagaacctgtgtctattagtctttatttcctacattaaataaatttacagtaaaatgatagtttattccaagctaatcatgactgatttgtaaatctaaagttagaaaagtctttaatggcaagttatctttataataagaaaccataattcaaatgtgttattatttttattcaaattttttatgaacacaggaaagttgtctgacagaagtttgatgagaggaatttgactcagaagactgaaatatcctttaaccttactataaaatatcttacaaaatactcattgatttcacagcattagaatcatcaaggttaagcaagacatcaacatgcaaattctgattaaaaggggtccattatgatacaattcagggaatttccacaaaaatcctatggaacagtatcttccccatttaaaagttaatatggttttacagaaaatcaatgatacaatttgaataataatacaatttgaatca

SEQ ID NO: 322156 - DNA, 799 bp, Homo sapiens
atggcttccctgttatgttgtcatgaggcatgtggcacaagtgtcatcgtaggggtacctcctgattcccaaaacctctcaatgaaccctatgctgctactgactggacgtacctggaagggagctattcttggtggctttaaacgtcaagaaagagtcccaaaacttgtggctgactctacggctaaaacaccccctatcgaatgcatcaataatccctcgccccccttttcaccaaccaaaagaaggattatcagccgattcactcccggtataagaataccacctactactcgccatcctatcatacaccacaccggctgtccctaaaaatgaactataaaattgatgaacacaaaaaaaaatgcaccaagcagcggtagtagaccaaacaccacgccaatactttccacatatttcccacctttacaccagccacactattcttctcactatttttcccaaacccatttattcgacttgaaccttacaacccaattgatatcgccacaaccgcctacaatattgatatgctccccgttttttttcaaccgtcacactcctgtgtccaagtgtttcaccccaagtccacccactcccgtctcctcccattgcacaatacatgccccggcaacacccattcaacacgcgatgcataagtgcatacgtactcataccgcgccgctatcacacccctataacatttaactgttgcccaccacaccacaatccccatctttttatgtgttcatcgacgctttctaccgtccccctgtcgcagtacctcccacccgcgacc

SEQ ID NO: 322157 - DNA, 3216 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccgagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatc

SEQ ID NO: 322158 - DNA, 3303 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccgagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagatagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatcatttactgtgtgatcttcagtaagtctctcaggctctctgagcttgttcatcctttgttttgaaaaaattactcaaccaatccattacagcttaaccaagattaaatgggatgatgttaatgaaagagcttcgccaattaagaa

SEQ ID NO: 322159 - DNA, 3162 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggagaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccgagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatc

SEQ ID NO: 322160 - DNA, 3162 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggcctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccgagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatc

SEQ ID NO: 322161 - DNA, 3162 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttcaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccgagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatc

SEQ ID NO: 322162 - DNA, 3104 bp, Homo sapiens
caccattaaagaactctttaatttttagatacttttatattgcgacaaacataccatttgtattactctgtattgttttaataaacacttggtatttctacatcatctcagtaattacatgtttaagcatctgccaagaacattttcaggataatttaaaatacatcaatacatcatcaaaacacttttggaacattcagatggtttgtagtttggttctcacagagaagactggatggtacatctttgtttttggattgggcttcttaggttatttcccaactcccttcacaggaggaatgtaagcaaacattttgatctctcacacatgctcttcttggcaggattccaggctccacagccgctgcaagaccagcaagtatttccgctccctcgacatcttgggcaagttatttaacccccaaaatgaaggatttgaactgaagataatttctgcaagttacagtattctttgtcaggcccatgtaaattatggacctctgcggaaaagaagacagttggatctcttgcagggatgctggtctgtccttctccaggctttggagtcacatcttcgcactgctcatcattacctctgttgcaaacatggccatctaagatctgcgggtaggcacatctccgtctttgatctcagcctggaaaagctatgcaatatatctgctttatgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcgcacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatc

SEQ ID NO: 322163 - DNA, 591 bp, Homo sapiens
atggcttccctgttatgttgtcatgaggcatgtggcacaagtgtcatcgtaggggtacctcctgattcccaaaacctctcaatgaaccctatgctgctactgactggacgtacctggaagggagctattcttggtggctttaaaagtaaagaatgtgtcccaaaacttgtggctgattttatggctaagaagttttcattggatgcattaataacccatgttttaccttttgaaaaaataaatgaaggatttgacctgcttcactctgggaaaaggtagattttttagttagttttctgttttgcttttttttctaccataggggattgtctagcagaaaatgaaaaggtggaaggatgagaaaaattagagtgccttggttcttccattaccagttcagtctttacatggagagcttgtaagagaagtttaaaacctctgtgagatgctaaaaacagttgctttgcatttcctattgtgctgaagccaaattatgttgattacagcaaatccgaatgatcagagacactcagccttctttaaaagagaacaatcacctttgccaaaaaaaaaaaagtctttttaaataac

SEQ ID NO: 322164 - DNA, 2843 bp, Homo sapiens
ttcatttcttcgcggcgcggggcggggctgggcgcggggtgaaagaggcgaagcgagagcggaggccgcactccagcactgcgcagggaccgccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacattgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcaga

SEQ ID NO: 322165 - DNA, 473 bp, Homo sapiens
ggttaaaacccaacaactctggtcccaagcccaccgttagaatggcaccgcacactgttttagagacgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcaga

SEQ ID NO: 322166 - DNA, 579 bp, Homo sapiens
accttgtattacaataaaattctgtgaggaagtagaatagaaatgagtttcaaaaattaaagataaataatataaattttttaaactaagagcttgttcttgtatttttttcaaatggataatgtagacactcaaattccattgatatatttaagagtgatttgacttatattaagagttgtattataaaatattaatatttataatttaaaagaaattacattctttgcagctatttaggataaaaagtttaaatatcaaataaatgtatgccaggggtcatttgcttttaagattcttccagcaaattattaagcaaaaagagcatgccttgctttttcatggtaaagagaagaagggagcagggagaggggaaactttacttcataccatttgatcctcatatttttttgcatcttaagaagagaacaaatgatcctaccaatattgaactatttttctctctttgattagatatggtccggcttgctttcacagatgtttcgataaaaaattttgaagagttttttaacctccacagaaccgccaaggtaaaaccaaccatgtgttgtttaaaaa

SEQ ID NO: 322167 - DNA, 2868 bp, Homo sapiens
gggcagcgcccagtaaccgcgctaggagcgcggagaagggcattgggagagcggcgttcgtggcggagactagcgctccggagcacgggcacgacgggggcaccttctcggctgctaccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacattgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcaga

SEQ ID NO: 322168 - DNA, 3318 bp, Homo sapiens
gaccagggccggccttccgattccccattcattccagaagcaccgaaccacgctgtgcccggatcccaagtgcagcggcacccagcgtgggcctggggttgccggttgacccggtcctcagcctggtagcagaggccaggccagtgccacaaggcacctaagtccacctgggcctggagcaggacaggttgcaaaagaaaatatctcgggacccccaaactccttatgctaagggaaacatcgagcctgggaactgagccatcaacgctgccattctttttcccaaacagaaccctgttgtcagaggtacacccagagcaactccacaccgggtgcatgccacagcaactccatcttaaataggagctggtaaaacgaggctgatacctactgggctgcattcccagacggcatagcgaggaggtgctgaagagcgcaggtttggagaatgatcacctggattggaaccatagctctaccaatatggaacccagctccttaggcctcggtcttctcatggagaacatggtgtgataatcctactcctctgggagggtggctgttaagccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacattgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcaga

SEQ ID NO: 322169 - DNA, 2862 bp, Homo sapiens
ttcatttcttcgcggcgcggggcggggctgggcgcggggtgaaagaggcgaagcgagagcggaggccgcactccagcactgcgcagggaccgccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagaggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacattgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcaga

SEQ ID NO: 322170 - DNA, 2787 bp, Homo sapiens
ttcatttcttcgcggcgcggggcggggctgggcgcggggtgaaagaggcgaagcgagagcggaggccgcactccagcactgcgcagggaccgccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacattgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcaga

SEQ ID NO: 322171 - DNA, 1824 bp, Homo sapiens
tataaaaacatatctatacatgtctgtgtatttttgtgatgaccaagtctatagtcaaacaccatgatacacatttattatatcagctggaagagctcattccatatcattgtggaaatatcctagattgctaaaattcagtcataatcctattcaatccagttctgagtatttgttgggtaccaactgcaagacattccatccagttgtaagcaactgaaatttgccttgactttccccaacagcaaaaaggcagacatgcgtgttctggctacatcaaggtggaaatcggtcctgtgttctcttctagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcaga

SEQ ID NO: 322172 - DNA, 1485 bp, Homo sapiens
accttgtattacaataaaattctgtgaggaagtagaatagaaatgagtttcaaaaattaaagataaataatataaattttttaaactaagagcttgttcttgtatttttttcaaatggataatgtagacactcaaattccattgatatatttaagagtgatttgacttatattaagagttgtattataaaatattaatatttataatttaaaagaaattacattctttgcagctatttaggataaaaagtttaaatatcaaataaatgtatgccaggggtcatttgcttttaagattcttccagcaaattattaagcaaaaagagcatgccttgctttttcatggtaaagagaagaagggagcagggagaggggaaactttacttcataccatttgatcctcatatttttttgcatcttaagaagagaacaaatgatcctaccaatattgaactatttttctctctttgattagatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcaga

SEQ ID NO: 322173 - DNA, 1695 bp, Homo sapiens
aaaactttccatccagagtgaggaaagagcctacaggaaatgagcctgggggacagactgggccaagagaccagacttagccactcttagaaataggtgtccccggcacagatgaggagcctggccccatgattcaccagctggaggccttgggatgtgccacttccagcctgtgcccctgactcctcattcataaaagaagactgataaggccttcctcagaaggttgagatggacgtggagtaagatgtttaggatgcacctgccactgtgcactgtgcctctcctcaaggcctggagggtccaggggtgaagtttctcctcctcaggttttggcaaccagtttctctaaaccccgggaacataaaacataattttctgacttaaacatggctttcctgctcatccctgtggattatctgatggatatgacaatcctcgccatcagatatagaagcccctaaaagagaaaggaaagaagctgagttacggggcctgaaagcaagcctgtgcaggtccccaggccccgggatgggggtccggcccatctgtggctcaagcctcctgggaagctctgaccctcagccagggctagaaacctgccttagatacaccagggcgcggcccagagggctgttccaggaaacgtgctgtttcactcacgttgggtaacctggtatttacggacttcttacctactttcctgtgactcaggaatttgtgtcttgagggaaactgtatttatttattttttactgtagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcaga

SEQ ID NO: 322174 - DNA, 1169 bp, Homo sapiens
  misc_feature (891)..(891): n is a, c, g, or t
gaccagggccggccttccgattccccattcattccagaagcaccgaaccacgctgtgcccggatcccaagtgcagcggcacccagcgtgggcctggggttgccggttgacccggtcctcagcctggtagcagaggccaggccagtgccacaaggcacctaagtccacctgggcctggagcaggacaggttgcaaaagaaaatatctcgggacccccaaactccttatgctaagggaaacatcgagcctgggaactgagccatcaacgctgccattctttttcccaaacagaaccctgttgtcagaggtacacccagagcaactccacaccgggtgcatgccacagcaactccatcttaaataggagctggtaaaacgaggctgatacctactgggctgcattcccagacggcatagcgaggaggtgctgaagagcgcaggtttggagaatgatcacctggattggaaccatagctctaccaatatggaacccagctccttaggcctcggtcttctcatggagaacatggtgtgataatcctactcctctgggagggtggctgttaagccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggtaaggcagaaatgaagtgggccgttgggttctttcttttctttctttcttttttttgagacaaggtctcgctccagcctggacaacagagggagactctgtctcaaaaaaanaaaaaaaaacctacagctgttcaaggaccagctgacaggtcaagtgtggccttttctggtctttgaacacatcatagaaagtgacaaatgctgcaaagccatgaagaacatgaactataaacgggtagactaactgcccagcttagacacttatctatgccacaaaacagctgaatttgtcacatttatatattgcaatatgggaagtattgagatcaaaacaggattccattgatctaattatattaagctaataaactaattttttgaatttttga

SEQ ID NO: 322175 - DNA, 821 bp, Homo sapiens
cgcgggcgcgggcaggcggacggacttgcaggaaatgcagccgggaggatgggcaggttgtgggatgctccgccgttccgcgaccacccgcctccccggcccagcagaaccgggtccaggctgggggaggtgctagcggtgtatgcacctaagtccacctgggcctggagcaggacagaaccctgttgtcagaggtacacccagagcaactccacaccgggtgcatgccacagcaactccatcttaaataggagctggtaaaacgaggctgatacctactgggctgcattcccagacggcatagcgaggaggtgctgaagagcgcaggtttggagaatgatcacctggattggaaccatagctctaccaatatggaacccagctccttaggcctcggtcttctcatggagaacatggtgtgataatcctactcctctgggagggtggctgttaaggtgagtgattgcacacgagtccctctagctgatgttaccgagcggtccttgtttttagagctcccaagagggtggcgggccacttccaagatggcggcaagcctcttgttctctgacctggggttcttggcctcacagattccaaggaatggaatcttggggcatgtggtgagtgttctcattaggacgaacccaggcacttagacatgcgggaacaatggcgagcctttagcccgaatgggagcggcaatgggtgcctcgctggatcaggagcacagcggacacactgccggatccagaggggtggacatcagtggtgggtctgtgatggcggcaaacaacagcagacagcaaatggcagtggtg

SEQ ID NO: 322176 - DNA, 3309 bp, Homo sapiens
cgcgggcgcgggcaggcggacggacttgcaggaaatgcagccgggaggatgggcaggttgtgggatgctccgccgttccgcgaccacccgcctccccggcccagcagaaccgggtccaggctgggggaggtgctagcggtgtatgcacctaagtccacctgggcctggagcaggacaggttgcaaaagaaaatatctcgggacccccaaactccttatgctaagggaaacatcgagcctgggaactgagccatcaacgctgccattctttttcccaaacagaaccctgttgtcagaggtacacccagagcaactccacaccgggtgcatgccacagcaactccatcttaaataggagctggtaaaacgaggctgatacctactgggctgcattcccagacggcatagcgaggaggtgctgaagagcgcaggtttggagaatgatcacctggattggaaccatagctctaccaatatggaacccagctccttaggcctcggtcttctcatggagaacatggtgtgataatcctactcctctgggagggtggctgttaagccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacattgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcaga

SEQ ID NO: 322177 - DNA, 2744 bp, Homo sapiens
ttcatttcttcgcggcgcggggcggggctgggcgcggggtgaaagaggcgaagcgagagcggaggccgcactccagcactgcgcagggaccggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacattgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcaga

SEQ ID NO: 322178 - DNA, 2705 bp, Homo sapiens
ttcatttcttcgcggcgcggggcggggctgggcgcggggtgaaagaggcgaagcgagagcggaggccgcactccagcactgcgcagggaccgccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacattgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcaga

SEQ ID NO: 322179 - DNA, 1678 bp, Homo sapiens
ttcatttcttcgcggcgcggggcggggctgggcgcggggtgaaagaggcgaagcgagagcggaggccgcactccagcactgcgcagggaccgccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcaga

SEQ ID NO: 322180 - DNA, 3105 bp, Homo sapiens
  misc_feature (3051)..(3051): n is a, c, g, or t
ttcatttcttcgcggcgcggggcggggctgggcgcggggtgaaagaggcgaagcgagagcggaggccgcactccagcactgcgcagggaccgccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacattgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccaatccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagaaaaaaaaaaaaaaaaactcgagttttttttttttttttttttttgcagtcagcaggtttactatgtttattaaagtcacataaatggtttgacaaaagtgcacaatagaatgacatcaccgttttgttataaatcacagtgaattactagaatacaacagtgtagttcctctgcacggaggattgcaggatggggtgaaaaacacaangtcttttccatcgattaggccagtcagattttactccccaactgtgtacctttg

SEQ ID NO: 322181 - DNA, 1372 bp, Homo sapiens
ttcatttcttcgcggcgcggggcggggctgggcgcggggtgaaagaggcgaagcgagagcggaggccgcactccagcactgcgcagggaccgccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacattgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcaggtgcgcttgcctgggtttcatcatggatcagtccaagcccagg

SEQ ID NO: 322182 - DNA, 2782 bp, Homo sapiens
cggggacatgaggtggatactgttcattggggcccttattgggtccagcatctgtggccgagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcaggcccttttagacaatgaagatgatgaaatgcaacacaatgaagggcaagaacggagcagtaataacttcaactacggggcttaccattccctggaagctatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcgtatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctccctggagtcgtgtgtcctggcggtgtccctgcaagaactggttctgccagcctgctcaattttggtcctgctgtttttgatgagccttttgtctgtttctccttccaccctgctggctgggcggctgcactcagcatcaccccttcctgggtggcatgtctctctctacctcatttttagaaccaaagaacatctgagatgattctctaccctcatccacatctagccaagccagtgaccttgctctggtggcactgtgggagacaccacttgtctttaggtgggtctcaaagatgatgtagaatttcctttaatttctcgcagtcttcctggaaaatattttcctttgagcagcaaatcttgtagggatatcagtgaaggtctctccctccctcctctcctgttttttttttttggagacagagttttgctcttgttgcccaggctggagtgtgatggctcgatcttggctcaccacaacctctgcctcctgggttcaagcaattctcctgcctcagcctcttgagtagcttggtttataggcgcatgccaccatgcctggctaattttgtgtttttagtagagacagggtttctccatgttggtcaggctggtctcaaactcccaacctcaggtgatctgccctccttggcctcccagagtgctgggattacaggtgtgagccactgtgccgggcccgtcccctccttttttaggcctgaatacaaagtagaagatcactttccttcactgtgctgagaatttctagatactacagttcttactcctctcttccctttgttattcagtgtgaccaggatggcgggaggggatctgtgtcactgtaggtactgtgcccaggaaggctgggtgaagtgaccatctaaattgcaggatggtgaaattatccccatctgtcctaatgggcttacctcctctttgccttttgaactcacttcaaagatctaggcctcatcttacaggtcctaaatcactcatctggcctggataatctcactgccctggcacattcccatttgtgctgtggtgtatcctgtgtttccttgtcctggtttgtgtgtgtgtgtgtgtgtgtgtgtgtgtgtgtgtgtttgtgtgtgtgtgtctgtctattttgtatcctggaccacaagttcctaagtagagcaagaattcatcaaccagctgcctcttgtttcatttcacctcagcacgtaccatctgtccttttgttgttgttgttttgtttttgtttttttgcttttaccaaacatgtctgtaaatcttaacctcctgcctaggatttgtacagcatctggtgtgtgcttataagccaataaatattcaatgtgagtttcatgatca

SEQ ID NO: 322183 - DNA, 1123 bp, Homo sapiens
cttgggactgacctatgggaggatcaacttggactcctgtgttcacctgtgccctcttcactctttactaatttacttggatggcgacttccacttcatatagctcctagatgaggccagtgctgctgttcctctgatcacactccgaatggcaaagccccagataacttggacccaggtgctggccaataatgagtaatttagcaacatatgcctcaaaaaccatgcactacataagagacaataagttacttcgtgacaagtactatgatgagagttctaaggcaataaaatgtcagaaaatttccctaagatgaccccaggaataaggaatggagcctgtaaaaacactctttgggaggccgaggctggtctcaaactcccaacctcaggtgatctgccctccttggcctcccagagtgctgggattacaggtgtgagccactgtgccgggcccgtcccctccttttttaggcctgaatacaaagtagaagatcactttccttcactgtgctgagaatttctagatactacagttcttactcctctcttccctttgttattcagtgtgaccaggatggcgggaggggatctgtgtcactgtaggtactgtgcccaggaaggctgggtgaagtgaccatctaaattgcaggatggtgaaattatccccatctgtcctaatgggcttacctcctctttgccttttgaactcacttcaaagatctaggcctcatcttacaggtcctaaatcactcatctggcctggataatctcactgccctggcacattcccatttgtgctgtggtgtatcctgtgtttccttgtcctggtttgtgtgtgtgtgtgtgtgtgtgtgtgtgtgtgtgtgtttgtgtgtgtgtgtctgtctattttgtatcctggaccacaagttcctaagtagagcaagaattcatcaaccagctgcctcttgtttcatttcacctcagcacgtaccatctgtccttttgttgttgttgttttgtttttgtttttttgcttttaccaaacatgtctgtaaatcttaacctcctgcctaggatttgtacagcatctggtgtgtgcttataagccaataaatattcaatgtgagtttcatgatca

SEQ ID NO: 322184 - DNA, 1686 bp, Homo sapiens
cggggacatgaggtggatactgttcattggggcccttattgggtccagcatctgtggccgagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcaggcccttttagacaatgaagatgatgaaatgcaacacaatgaagggcaagaacggagcagtaataacttcaactacggggcttaccattccctggaagctatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcgtatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctcccgtgtgtgtgtgtgtttgtgtgtgtgtgtctgtctattttgtatcctggaccacaagttcctaagtagagcaagaattcatcaaccagctgcctcttgtttcatttcacctcagcacgtaccatctgtccttttgttgttgttgttttgtttttgtttttttgcttttaccaaacatgtctgtaaatcttaacctcctgcctaggatttgtacagcatctggtgtgtgcttataagccaataaatattcaatgtgagtttcatgatca

SEQ ID NO: 322185 - DNA, 1603 bp, Homo sapiens
cggggacatgaggtggatactgttcattggggcccttattgggtccagcatctgtggccgagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcaggcccttttagacaatgaagatgatgaaatgcaacacaatgaagggcaagaacggagcagtaataacttcaactacggggcttaccattccctggaagctatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcgtatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctccctgggcaacagagcaagactctgtcttaaaaaaagaaagaaagaaagtctgctgggagcggaggaggggtgcatgtggaggacacatcttccttccctcttcattggaggttcaaattcctaaaaactattacacgtgtggctcctcctcctggaacggaaggaataaagcacatacgcccagaa

SEQ ID NO: 322186 - DNA, 558 bp, Homo sapiens
agggggtgcagcaggcagactggggacccataggtcttcgtggaggctccaagccatgaaagccaggatactgctaaccatgcccagccccaggctcctccaacagctggtgacaaccggaagctccgggctgagcaaacattgaactcctaggcctggattgtggatgggaggagggagggttcaatcctggggtcagaattgggtggagaaagatgatgctcagcgtcagctctcttggtgaggcagttggccagagacaggtttgtggtccttgataagaggctgacagtgggaagacccctcaggcgaagatcatctcattcagccgccgcctccagacaggaggaggcagaattggcaggggtgtgctggctcctggccctggaatcagccctctcagtcaggcagggtggtgcagtgatatgaggagaacctctggggccagccggctccatgtggattccagctctgccaccaccaacttggggaccctgggaggccctctgttaaatttctgtgcttcggtgtctccatctgtttttgttgttgttgaga

SEQ ID NO: 322187 - DNA, 2867 bp, Homo sapiens
cctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 322188 - DNA, 2512 bp, Homo sapiens
cctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 322189 - DNA, 2625 bp, Homo sapiens
cctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 322190 - DNA, 2930 bp, Homo sapiens
cctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacagagtcttgtaaaggatccaaaagaaagagggagcaaaggttctgacatccagccaactagcgtggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 322191 - DNA, 2816 bp, Homo sapiens
ggccgcagtcggccggcctcctctgcacaggagcggacgcgggagcccctccgcacccgtcccctcccccgggtcgccttcgcctgcccccggggcgaggctccccgcgcgggttcgcgtcgcgtctgcagtggccgaggctgctgcctgccgggcagatgggtccgccttgttccggctgcagctttcgccgccggggcttgctggctgtcgggaactagtcaactggagtttttgttgacttcccacggttcaaaagggccttccagaatggggggctggaattaaatcttgggtctaacttaaaggaaggcgccatattattccataggtgatgctaatacctttgtgtttcgttatttgttttttaggaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 322192 - DNA, 2302 bp, Homo sapiens
gccagtctccaaaaaagccgttcaatagtattattgagcatctgtcagtggtattatcatgaccatcaccgaccagagcttggacgaggcgcaagcaaagaaacatgccctgaactgtcacagaatgaaaccagcgctcttcagcgtcctgtgtgagatcaaagagaaaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 322193 - DNA, 1598 bp, Homo sapiens
cctccgcctccattagcatttaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 322194 - DNA, 2260 bp, Homo sapiens
cctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagacgctagagacgtatcacgttaactgacacttctaggacttactagctacatcgacgggtacggtatgatctccattctctagtcttattggcatcctctgtaacctatcttctcgtttcccattcataagaagtagttatgtacatgtagtagtctcatgaaagtaatatgcaggcgtgtgcatctcgcaactatttaaaaacgccgtacgtgtgcacatcacttggctcgtttatcccacacaggtatcggtatcaccgctcgtaatactgaacacagttgtgaagttcgtatcttcatcccct

SEQ ID NO: 322195 - DNA, 1602 bp, Homo sapiens
cctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttatagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgtt

SEQ ID NO: 322196 - DNA, 509 bp, Homo sapiens
cctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacagaatgtcctcatttaaacttttttttaacaactcatggatttggtctctgagttactttacctctactcaagccagagctctgtgtccctacccaaatctcaccttgaattgaataatctccatgtg

SEQ ID NO: 322197 - DNA, 534 bp, Homo sapiens
cctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggtaagacgctgcgccccgcagtgggcctggagacccccgaggtgggggtcggagctactccttcgactctccagttgagagctgctgcttttgggcaccgccatctttgatcattctctccttcccacgtcctgatcttgagaaaaaactg

SEQ ID NO: 322198 - DNA, 543 bp, Homo sapiens
ctcgatgccagcatgggcctcgctgaagcccttcttcggcgtgttgatttattgccaagactttacttgatgggatggatttgttttacatgcatttaatcccactttaacacatgctgccaactcctgccacagtgggtttagaaaatacattttgctaatgcatctctgctctcatgttgtcatccgggtgttttaaattggggagtagaattaatatgtagacgtgcacccgttgaactgtgtttctcctttcaggctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgt

SEQ ID NO: 322199 - DNA, 2847 bp, Homo sapiens
aagctgtccggccgggatttatggatcgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggttcttctggttcttttaacctcccaaattctggggacatgttcatgaacatgcagagtctgaatggggattcttaccaagggtcccaagtcggagccaatgtgcaatcacaggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 322200 - DNA, 2754 bp, Homo sapiens
cctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 322201 - DNA, 2406 bp, Homo sapiens
ttgtttcctggagaataagtcaggagcaattacatgtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 322202 - DNA, 2269 bp, Homo sapiens
cgggaaagtgcaccagtgagctgtccgaggtcgtgaagctcacgggcgcggcggggcgagcacacggaaacatgccctgaactgtcacagaatgaaaccagcgctcttcagcgtcctgtgtgagatcaaagagaaaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 322203 - DNA, 1546 bp, Homo sapiens
cctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaagaaacatgccctgaactgtcacagaatgaaaccagcgctcttcagcgtcctgtgtgagatcaaagagaaaacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggtggataccctccgtcatgttatcaatcagacgggaggctacagtgatggccttggaggaaattcactgtacagtccacataatttaaatgctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgtt

SEQ ID NO: 322204 - DNA, 867 bp, Homo sapiens
cctccccctccccctccccctctttcttctcctccctcgtcgccgccgccgccgccgccgcctcagccttcgcctcagccgccgcccgctcccgcccgcgcgcggcgggatggacgatcaatccaggatgctgcagactctggccggggtgaacctggctggccactcggtgcaggggggcatggccctgccgcctcccccgcacggccacgaaggggcggacggcgacggcaggaagcaggacatcggcgacatcctccaccagatcatgaccatcaccgaccagagcttggacgaggcgcaagcaaacttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaa

SEQ ID NO: 322205 - DNA, 822 bp, Homo sapiens
tgatacacttatgtgagattttgaaaagtgaaaaatcaaaggtggaattgaccagtagatgtaaaagtacaacaaataaacaaaaatggcaatgttgaaagtgaaactgaaattcaacagaaataaaagaaatagcagactggggggatattgactttgacaccatgatgccagaggaacttagtgatggcaaacttatcaatataaaatgaggatattggttgtcaactaggttgtgtggtggtccttgatcttgtccatcaagtcctttttcccaaaggataactgaagaagatcacatacattccaacttattgagtctgataggtattcatctgatgagctcctcttcaactgaggattgaaatgctgtttttcttccctggtacaatgttaaagctttaaactcttgtcaatgatgtgatgtttcatctgcaatgatctacactagaaaaataaaaatgtagttactgacaaaaaagcaggaactactgctctaaggaaaaaaggacagctacatgaggaccacacaactcctggaagaggtttccctggcaacacaacttttccattcatctggttgcagtgttttcatccagtagcctgtcacctcactcaaaagcagggcaatggagagaaagaaacttaccaagttttttcttttaactagagagtagcctacttattgggccctgcaattaatttcagtactccaggcagatttataaaggaagctgctggaaggaattcattccctttttgctgttctgccttccaccttccactgtgtgaggacactgcaagaaagccctcatcagacac

SEQ ID NO: 322206 - DNA, 689 bp, Homo sapiens
tccggttctttattccggaagttgctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaaaaaacaacttttatttcagattgaaggggtacatgtacaggtttgttacattgcgtatatatggtacattgcataatggtgaagtttgggcttctagtggacccatcactcaaacagtgaacattgtacccatacatattttgtcaaccctcatgtccttcccatctgatatggttaggctttctgaacctgcc

SEQ ID NO: 322207 - DNA, 385 bp, Homo sapiens
ttctttttttaacgtttccacttttatgattatttcagaagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaa

SEQ ID NO: 322208 - DNA, 459 bp, Homo sapiens
  misc_feature (15)..(15): n is a, c, g, or t
aaaaaaaaaaatttntttttttttccccccccccccccttgggggttttttaaaaaaatagtgagcatctgctgttagctagacactgttgaatcaatacagtgaaacagacaggtaagcaggtggttttaatgcctcattctaagtgctatttaaattggatcttgaaagatgaataaggcctgccttaagttctgctaaaggcaatgttgttattaaggacgggtgaggaaggaccaagaagtctggctcctgcttttctacatgcctgtgaaggagacttttcatgaaactgaataaaagaaatcctttccgagatagaggagatttgtaggtgaatgcagaagtgtatccagctttgaaccatgcattccatctatattcctcctgtctgaactcatgctcttttgattatgttttgaaataaagggctgcattagttcttttaaaaaaaaaaaa

SEQ ID NO: 322209 - DNA, 661 bp, Homo sapiens
tccggttctttattccggaagttgctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaaaacaaaaaaaacaaaaacaaaaaaaacaacacaacaacaacaaaacagaaccacaccaccaaacaaaaaaccacgaccaaagcccacacaccaatcaccaccagcccccaacaccactgcgctaaacctgtagacccacacgacagagcaagccacaccacgcacc

SEQ ID NO: 322210 - DNA, 2061 bp, Homo sapiens
tccggttctttattccggaagttgctctcagaggcagcgtgcgggtgtgctctttgtgaaattccaccatggcgtaccgtggccagggtcagaaagtgcagaaggttatggtgcagcccatcgtatcctacgcaggatgtcaggactaggaggttcgggtcagaatacggggtgcgaaggcgcaggctgagggcaggcctgggatagtggagtacggatccacatcccatgagcccccggggctaccaagactggaagaaagcgcgggtagttgaaccgtgatggtggggaggtggtcttggggggacccctgccgtggggaatgcaggaatggacgcggcaaaaggagggaagagaacttcaggtgcggagtgaaaacgggagttaacggttttgggaaactccagggggatgaaagtggaatggatgttctttagtctttagaagacccgtaacgaatgcccagctgggcacttgttgtttgcgtaagcaccagacctcgcgtttagtaaacaaaggtgagacgggaatagcgtcgtccggttgtttcaggaagcagagtctatgctgcttttgtattttttccttagccactgtggtgcagaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaaaaaatttacattgcttcttactattcagcagtagaaactttttacacagtaacaccattcgttgttggtatttagttttctgaagggtcgcagttgccttgagcacttggtattcgcagagcttggacctgtagattttgaggcagattaggaattctgcctgatgggtaagcttccagtattgggaggtggagaaggggagggttcagaaaaataaataagagttattgcactaacaaaagtcttcatcacttgtagttctggatgctggaataccagagtttctaacctaaatacgttgggtacattatttaatgggggtccagtattgctcaacactctcattgagtcactgtgaggtctttgtgaattttatcgctaagatcagaatgtgagaagtatttggatatagggaaagaatgaagtgcctttcaagtacattaaaaatcagttaagagtttacaggaaagagactgagattggtaatctgaaaaggaccacaagcatagctggtaggcaaattgttaggcagaataatggtatgttggagaaatacacctgtctcttattcttatctcttaagaattttggttcttcccccagtgattgctggttgaattcttatatggacaggtttcccttcccccagtatcgcacatggttctagttagaatcctgttagatagtgagcatctgctgttagctagacactgttgaatcaatacagtgaaacagacaggtaagcaggtggttttaatgcctcattctaagtgctatttaaattggatcttgaaagatgaataaggcctgccttaagttctgctaaaggcaatgttgttattaaggacgggtgaggaaggaccaagaagtctggctcctgcttttctacatgcctgtgaaggagacttttcatgaaactgaataaaagaaatcctttccgagatagaggagatttgtaggtgaatgcagaagtgtatccagctttgaaccatgcattccatctatattcctcctgtctgaactcatgctcttttgattatgttttgaaataaagggctgcattagttcttttaaaaaaaaaaaa

SEQ ID NO: 322211 - DNA, 1794 bp, Homo sapiens
tccggttctttattccggaagttgctctcagaggcagcgtgcgggtgtgctctttgtgaaattccaccatggcgtaccgtggccagggtcagaaagtgcagaaggttatggtgcagcccatcgtatcctacgcaggatgtcaggactaggaggttcgggtcagaatacggggtgcgaaggcgcaggctgagggcaggcctgggatagtggagtacggatccacatcccatgagcccccggggctaccaagactggaagaaagcgcgggtagttgaaccgtgatggtggggaggtggtcttggggggacccctgccgtggggaatgcaggaatggacgcggcaaaaggagggaagagaacttcagagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaaaaaatttacattgcttcttactattcagcagtagaaactttttacacagtaacaccattcgttgttggtatttagttttctgaagggtcgcagttgccttgagcacttggtattcgcagagcttggacctgtagattttgaggcagattaggaattctgcctgatgggtaagcttccagtattgggaggtggagaaggggagggttcagaaaaataaataagagttattgcactaacaaaagtcttcatcacttgtagttctggatgctggaataccagagtttctaacctaaatacgttgggtacattatttaatgggggtccagtattgctcaacactctcattgagtcactgtgaggtctttgtgaattttatcgctaagatcagaatgtgagaagtatttggatatagggaaagaatgaagtgcctttcaagtacattaaaaatcagttaagagtttacaggaaagagactgagattggtaatctgaaaaggaccacaagcatagctggtaggcaaattgttaggcagaataatggtatgttggagaaatacacctgtctcttattcttatctcttaagaattttggttcttcccccagtgattgctggttgaattcttatatggacaggtttcccttcccccagtatcgcacatggttctagttagaatcctgttagatagtgagcatctgctgttagctagacactgttgaatcaatacagtgaaacagacaggtaagcaggtggttttaatgcctcattctaagtgctatttaaattggatcttgaaagatgaataaggcctgccttaagttctgctaaaggcaatgttgttattaaggacgggtgaggaaggaccaagaagtctggctcctgcttttctacatgcctgtgaaggagacttttcatgaaactgaataaaagaaatcctttccgagatagaggagatttgtaggtgaatgcagaagtgtatccagctttgaaccatgcattccatctatattcctcctgtctgaactcatgctcttttgattatgttttgaaataaagggctgcattagttcttttaaaaaaaaaaaa

SEQ ID NO: 322212 - DNA, 415 bp, Homo sapiens
tccggttctttattccggaagttgctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttctcaacctgggagggggtcctctga

SEQ ID NO: 322213 - DNA, 710 bp, Homo sapiens
tccggttctttattccggaagttgctctcagaggcagcgtgcgggtgtgctctttgtgaaattccaccatggcgtaccgtggccagggtcagaaagtgcagaaggttatggtgcagcccatcgtatcctacgcaggatgtcaggactaggaggttcgggtcagaatacggggtgcgaaggcgcaggctgagggcaggcctgggatagtggagtacggatccacatcccatgagcccccggggctaccaagactggaagaaagcgcgggtagttgaaccgtgatggtggggaggtggtcttggggggacccctgccgtggggaatgcaggaatggacgcggcaaaaggagggaagagaacttcagagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaa

SEQ ID NO: 322214 - DNA, 490 bp, Homo sapiens
tccggttctttattccggaagttgctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagcagtgaatggtgaagtctgtaggatgttgagaagaccccttgagcgtgtttaaagatgtctgctgcaacctgcatttactcaacttgttttacttgcacattattattaggtgacaataaatgctgtaggaagtttttgttaa

SEQ ID NO: 322215 - DNA, 380 bp, Homo sapiens
tccggttctttattccggaagttgctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattaatgaccagtccatgggtgagatgcagataatcggaggcgatgatctttcaacgctggctggaaagaaaacacttggtagacgggactcgagtgatgattgggagattcctgatgggcagattacagtgggacaaagaattggatctggatcatttggaacagtctac

SEQ ID NO: 322216 - DNA, 977 bp, Homo sapiens
tccggttctttattccggaagttgctctcagaggcagcgtgcgggtgtgctctttgtgaaattccaccatggcgtaccgtggccagggtcagaaagtgcagaaggttatggtgcagcccatcgtatcctacgcaggatgtcaggactaggaggttcgggtcagaatacggggtgcgaaggcgcaggctgagggcaggcctgggatagtggagtacggatccacatcccatgagcccccggggctaccaagactggaagaaagcgcgggtagttgaaccgtgatggtggggaggtggtcttggggggacccctgccgtggggaatgcaggaatggacgcggcaaaaggagggaagagaacttcaggtgcggagtgaaaacgggagttaacggttttgggaaactccagggggatgaaagtggaatggatgttctttagtctttagaagacccgtaacgaatgcccagctgggcacttgttgtttgcgtaagcaccagacctcgcgtttagtaaacaaaggtgagacgggaatagcgtcgtccggttgtttcaggaagcagagtctatgctgcttttgtattttttccttagccactgtggtgcagaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaa

SEQ ID NO: 322217 - DNA, 1579 bp, Homo sapiens
tccggttctttattccggaagttgctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaaaaaatttacattgcttcttactattcagcagtagaaactttttacacagtaacaccattcgttgttggtatttagttttctgaagggtcgcagttgccttgagcacttggtattcgcagagcttggacctgtagattttgaggcagattaggaattctgcctgatgggtaagcttccagtattgggaggtggagaaggggagggttcagaaaaataaataagagttattgcactaacaaaagtcttcatcacttgtagttctggatgctggaataccagagtttctaacctaaatacgttgggtacattatttaatgggggtccagtattgctcaacactctcattgagtcactgtgaggtctttgtgaattttatcgctaagatcagaatgtgagaagtatttggatatagggaaagaatgaagtgcctttcaagtacattaaaaatcagttaagagtttacaggaaagagactgagattggtaatctgaaaaggaccacaagcatagctggtaggcaaattgttaggcagaataatggtatgttggagaaatacacctgtctcttattcttatctcttaagaattttggttcttcccccagtgattgctggttgaattcttatatggacaggtttcccttcccccagtatcgcacatggttctagttagaatcctgttagatagtgagcatctgctgttagctagacactgttgaatcaatacagtgaaacagacaggtaagcaggtggttttaatgcctcattctaagtgctatttaaattggatcttgaaagatgaataaggcctgccttaagttctgctaaaggcaatgttgttattaaggacgggtgaggaaggaccaagaagtctggctcctgcttttctacatgcctgtgaaggagacttttcatgaaactgaataaaagaaatcctttccgagatagaggagatttgtaggtgaatgcagaagtgtatccagctttgaaccatgcattccatctatattcctcctgtctgaactcatgctcttttgattatgttttgaaataaagggctgcattagttcttttaaaaaaaaaaaa

SEQ ID NO: 322218 - DNA, 495 bp, Homo sapiens
tccggttctttattccggaagttgctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaa

SEQ ID NO: 322219 - DNA, 2520 bp, Homo sapiens
tgcggcccccgcctgccctttaaaagagcggggcctgcgccggccgcgccacaccgcggggaccaggaggcacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggctgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggaggcagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacaccatttatctacccaagggcagaaagtagaacttactattcattaaatgtttgacacaattggaattgtctttaatttctgtcagaatgctattgaaaatgtgaattgcatgacttgtagcatattcttttctgcaaaatagacatattaacatgcttatgacaatgactgtgctactgtctttggaaaaatgtttgtctcagttggaaataataaaagattcacctgagaccaaaa

SEQ ID NO: 322220 - DNA, 547 bp, Homo sapiens
  misc_feature (12)..(12): n is a, c, g, or t
  misc_feature (32)..(32): n is a, c, g, or t
  misc_feature (49)..(49): n is a, c, g, or t
  misc_feature (57)..(57): n is a, c, g, or t
  misc_feature (63)..(63): n is a, c, g, or t
taagtgccccantataaaaatccccaatcccntgcccaagatcatctcnacaagagnccaatnacacccaaccccacccctgtgagaagaatccacccaccaggaggcagaaaatgaaaaggacagggctgaccagacagtcctgacagaggacgagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacaccatttatctacccaagggcagaaagtagaacttactattcattaaatgtttgacacaattggaattgtctttaatttctgtcagaatgctattgaaaatgtgaattgcatgacttgtagcatattcttttctgcaaaatagacatattaacatgcttatgacaatgactgtgctactgtctttggaaaaatgtttgtctcagttggaaataataaaagattcacctgagaccaaaa

SEQ ID NO: 322221 - DNA, 2616 bp, Homo sapiens
tgcggcccccgcctgccctttaaaagagcggggcctgcgccggccgcgccacaccgcggggaccaggaggcacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggtcatttatttgcagaagatattacagatttccagcggaaagagaaagtgctgaaatgggtgtgttctcaagtagccatttggaggatgaaagaacactgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggaggcagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacaccatttatctacccaagggcagaaagtagaacttactattcattaaatgtttgacacaattggaattgtctttaatttctgtcagaatgctattgaaaatgtgaattgcatgacttgtagcatattcttttctgcaaaatagacatattaacatgcttatgacaatgactgtgctactgtctttggaaaaatgtttgtctcagttggaaataataaaagattcacctgagaccaaaa

SEQ ID NO: 322222 - DNA, 2463 bp, Homo sapiens
tgcggcccccgcctgccctttaaaagagcggggcctgcgccggccgcgccacaccgcggggaccaggaggcacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggctgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggaggcagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaattcagccaaaggggctgactgtcattggagcggtgggcactgttaagaagcagccatcacatgatctgtttttcaccacttcactgaaagacaccatttatctacccaagggcagaaagtagaacttactattcattaaatgtttgacacaattggaattgtctttaatttctgtcagaatgctattgaaaatgtgaattgcatgacttgtagcatattcttttctgcaaaatagacatattaacatgcttatgacaatgactgtgctactgtctttggaaaaatgtttgtctcagttggaaataataaaagattcacctgagaccaaaa

SEQ ID NO: 322223 - DNA, 1723 bp, Homo sapiens
tgcggcccccgcctgccctttaaaagagcggggcctgcgccggccgcgccacaccgcggggaccaggaggcacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggctgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggaggcagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgccaatccggtaggaaccagacaagaaacggacgggcaaagaccacgcgccagaaacccaggacggaaggcgcccaacggcgtcaaacgaacaacacacacagaaagaacccgagaatatacgaccccgcgactaagagcgcatcgacagaagacccacccagacagacgctcccatccgccgactagaaccaagcggaacggaacacgaaccgtgaactccatgagcgcaaacccagcgacgcagccgcaccacgcgccacccccgc

SEQ ID NO: 322224 - DNA, 837 bp, Homo sapiens
tgcggcccccgcctgccctttaaaagagcggggcctgcgccggccgcgccacaccgcggggaccaggaggcacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggctgtcaattccatgccagtggataacagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacaccatttatctacccaagggcagaaagtagaacttactattcattaaatgtttgacacaattggaattgtctttaatttctgtcagaatgctattgaaaatgtgaattgcatgacttgtagcatattcttttctgcaaaatagacatattaacatgcttatgacaatgactgtgctactgtctttggaaaaatgtttgtctcagttggaaataataaaagattcacctgagaccaaaa

SEQ ID NO: 322225 - DNA, 508 bp, Homo sapiens
gaggtaggttgactaatgcagcttctaacatgcctaaaattcccctttgcactcatgctccatcaaactacagcaaaagaaattggttcgggacctcatgcctccacttttctgtattttccagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacaccatttatctacccaagggcagaaagtagaacttactattcattaaatgtttgacacaattggaattgtctttaatttctgtcagaatgctattgaaaatgtgaattgcatgacttgtagcatattcttttctgcaaaatagacatattaacatgcttatgacaatgactgtgctactgtctttggaaaaatgtttgtctcagttggaaataataaaagattcacctgaga

SEQ ID NO: 322226 - DNA, 2466 bp, Homo sapiens
tgcggcccccgcctgccctttaaaagagcggggcctgcgccggccgcgccacaccgcggggaccaggaggcacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggctgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggaggcagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacaccatttatctacccaagggcagaaagtagaacttactattcattaaatgtttgacacaattggaattgtctttaatttctgtcagaatgctattgaaaatgtgaattgcatgacttgtagcatattcttttctgcaaaatagacatattaacatgcttatgacaatgactgtgctactgtctttggaaaaatgtttgtctcagttggaaataataaaagattcacctgagaccaaaa

SEQ ID NO: 322227 - DNA, 2443 bp, Homo sapiens
tgcggcccccgcctgccctttaaaagagcggggcctgcgccggccgcgccacaccgcggggaccaggaggcacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggctgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggaggcagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacaccatttatctacccaagggcagaaagtagaacttactattcattaaatgtttgacacaattggaattgtctttaatttctgtcggtattgagcaggtgatggctgactggagcatatctttctggaaatgacttttactggtttttgatggggcgcctgg

SEQ ID NO: 322228 - DNA, 1359 bp, Homo sapiens
tgcggcccccgcctgccctttaaaagagcggggcctgcgccggccgcgccacaccgcggggaccaggaggcacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggctgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacaccatttatctacccaagggcagaaagtagaacttactattcattaaatgtttgacacaattggaattgtctttaatttctgtcagaatgctattgaaaatgtgaattgcatgacttgtagcatattcttttctgcaaaatagacatattaacatgcttatgacaatgactgtgctactgtctttggaaaaatgtttgtctcagttggaaataataaaagattcacctgagaccaaaa

SEQ ID NO: 322229 - DNA, 585 bp, Homo sapiens
tgacagaaacagaggaacagacattttaacaagaagaaaggtatcgtacagcgccattatcaatgaaagaaatgtaaatttaaatttaagatacaattgtaaagttgcagtgatgacttttgtgaaacaaaaacttatgtatcattttagtgatactcttaagattatttgttttttggcagtaaatgtgaaaattctttgttgttctactttatgaatagaacttaaggaaataactccaaaacaatgtaatttgtataagaaggttcataaaaatcctgtaaggtttaaattagtttagaagaaaaataatagtttgctgtaactttttctccctaaagaaacaaggtccaactaatccaatgctgtttcatcttgttcgagacgtcaaacaggtaagagattattttttgcttttgaaaaatgttattttaaaaaatcatttatatttcatgttttttaaaaaaaaaatcatttaaatacattttagaaataccaataaaattacagtttacagaacaagataaaatatgggctgaatttgtggtaagagaggagtaaagagcataatgtatcagaaaacaa

SEQ ID NO: 322230 - DNA, 578 bp, Homo sapiens
agaggtggaggttgcagtgagcctagattgctgccactgcactccagcctgggtgacagcagaactctgtctcaaaaaaaagatgtggaattcttttctgcaaatgttctctaatagtataccttcttcagtctgtcgatatatgtatgctattattttacaagtaatacatgttgattgtattggaaattatagaaaagattatattggattgtttagaaaatatttttaaatgtgaagaaaaatataaaaattactcccttgttccactttccccactctcaagtcagactatgttgttttcatagttagtagctagcagtctaccccactagattatatgcttcacagagggaagggaccctcaagacttcactggattgagtagcacccaataccttgcttgctgcctggtttgtgatgggcatactgtaagaaaaaaaaatctgaatgacaaaatgtttttccataataccagacttcctcttgaagagatgggtcgtaatgttgtagtcttacatgcttacgtagacaatcaaagcaagaatactcaataaatggctatttaccacttgaaa

SEQ ID NO: 322231 - DNA, 300 bp, Homo sapiens
  misc_feature (1)..(3): n is a, c, g, or t
  misc_feature (10)..(10): n is a, c, g, or t
nnnccgtccncagccccgtcgccggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttcccgagatcgcgccactgcactctagcctgggggacagagcgagactccgtctc

SEQ ID NO: 322232 - DNA, 8087 bp, Homo sapiens
  misc_feature (1)..(3): n is a, c, g, or t
  misc_feature (10)..(10): n is a, c, g, or t
nnnccgtccncagccccgtcgccggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagagcccgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatgggatagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggccaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccacctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccaataacaatacttctgaaaacactttgaaacgagcgagttctcttgctggatttactgactgtcacagaacttccattcctgttcattcagaacaagaaaaaatcagtagaaggccatctaccgaagacactcatgaagtagattccaaagcagctttaataccggattggttacaagatagaccatcaaacagagaaatgccatctgaagaaggaacattaaatggtctcacttctccatttaagccagctatggatacaaattactattattcagctgtggaaagaaataacttgatgaggttatcacagagcattccatttacacctgtgcctccaagaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttataaagaagatacagttctgcatctctgtctgagagaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgccctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttaccagatgtttagtgagtttaatcattctgaaaaattatctgacattttcagggtgtcaatttgagtatcagtttttttaaatgaaccatttgtatacctgtgcttttgatctcctgtcctgtacaatgtttaaattaatactgatttcttactgtcttcttagaaatctgttttttgttaggccaaaaaagggcaatatgggctgtctgttgatttttaattttatattgattattttcacaggattataatagtagctatacttttttttttttttttttttttgagacggagtctcgctcttgcactccagcctgggtgacagcagaactctgtctcaaaaaaaagatgtggaattcttttctgcaaatgttctctaatagtataccttcttcagtctgtcgatatatgtatgctattattttacaagtaatacatgttgattgtattggaaattatagaaaagattatattggattgtttagaaaatatttttaaatgtgaagaaaaatataaaaattactcccttgttccactttccccactctcaagtcagactatgttgttttcatagttagtagctagcagtctaccccactagattatatgcttcacagagggaagggaccctcaagacttcactggattgagtagcacccaataccttgcttgctgcctggtttgtgatgggcatactgtaagaaaaaaaaatctgaatgacaaaatgtttttccataataccagacttcctcttgaagagatgggtcgtaatgttgtagtcttacatgcttacgtagacaatcaaagcaagaatactcaataaatggctatttaccacttgaaa

SEQ ID NO: 322233 - DNA, 7679 bp, Homo sapiens
  misc_feature (1)..(3): n is a, c, g, or t
  misc_feature (10)..(10): n is a, c, g, or t
nnnccgtccncagccccgtcgccggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagagcccgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatgggatagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggccaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccacctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccaataacaatacttctgaaaacactttgaaacgagcgagttctcttgctggatttactgactgtcacagaacttccattcctgttcattcagaacaagaaaaaatcagtagaaggccatctaccgaagacactcatgaagtagattccaaagcagctttaataccggattggttacaagatagaccatcaaacagagaaatgccatctgaagaaggaacattaaatggtctcacttctccatttaagccagctatggatacaaattactattattcagctgtggaaagaaataacttgatgaggttatcacagagcattccatttacacctgtgcctccaagaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttataaagaagatacagttctgcatctctgtctgagagaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgccctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttaccagatgtttagtgagtttaatcattctgaaaaattatctgacattttcagggtgtcaatttgagtatcagtttttttaaatgaaccatttgtatacctgtgcttttgatctcctgtcctgtacaatgtttaaattaatactgatttcttactgtcttcttagaaatctgttttttgttaggccaaaaaagggcaatatgggctgtctgttgatttttaattttatattgattattttcacaggattataatagtagctatacttttttttttttttttttttttgagacggagtctcgctctgttgcttgggctggagtgcagtggtgcgatctcagctcaccacaaccgccgccttccgggtttaagtgattctcctgcctcagcctcccgagtagctgggactacaggcacacgccaccatgcccagctaatt

SEQ ID NO: 322234 - DNA, 4817 bp, Homo sapiens
  misc_feature (1)..(3): n is a, c, g, or t
  misc_feature (10)..(10): n is a, c, g, or t
nnnccgtccncagccccgtcgccggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagagcccgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatgggatagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggccaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccacctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccaataacaatacttctgaaaacactttgaaacgagcgagttctcttgctggatttactgactgtcacagaacttccattcctgttcattcagaacaagcagaaaaaaaaagtcgacgcggccgcgaatttagtagtagtagtagtagtagtaggcggccgc

SEQ ID NO: 322235 - DNA, 4336 bp, Homo sapiens
ggaaattgattccctaaatctgtctgtgtctctgtacttcttgaaaatcttcacgtaccacagagataggtacacttcagtttgaaccagtgatacaattcattatgtagataaagatgcccatgacttgcttagcttaatagatttttttttacgtaatctcctagatgttaagatttatatagtgatgaaattcttctgaaagctatcactaggaacaaaaagaatctcaaagattttttgtgtttaatggatttttttggtctattagaacattagaagcttttagaaagatttgtcatagtgtttaaacttccttgtattttaacagtgttcattttttaacaggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggccaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccacctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccaataacaatacttctgaaaacactttgaaacgagcgagttctcttgctggatttactgactgtcacagaacttccattcctgttcattcagaacaagaaaaaatcagtagaaggccatctaccgaagacactcatgaagtagattccaaagcagctttaataccggattggttacaagatagaccatcaaacagagaaatgccatctgaagaaggaacattaaatggtctcacttctccatttaagccagctatggatacaaattactattattcagctgtggaaagaaataacttgatgaggttatcacagagcattccatttacacctgtgcctccaagaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttataaagaagatacagttctgcatctctgtctgagagaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgccctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttac

SEQ ID NO: 322236 - DNA, 7190 bp, Homo sapiens
  misc_feature (1)..(3): n is a, c, g, or t
  misc_feature (10)..(10): n is a, c, g, or t
nnnccgtccncagccccgtcgccggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagagcccgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatgggatagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggccaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaattttttgttagtacaccacctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccaataacaatacttctgaaaacactttgaaacgagcgagttctcttgctggatttactgactgtcacagaacttccattcctgttcattcagaacaagaaaaaatcagtagaaggccatctaccgaagacactcatgaagtagattccaaagcagctttaataccggattggttacaagatagaccatcaaacagagaaatgccatctgaagaaggaacattaaatggtctcacttctccatttaagccagctatggatacaaattactattattcagctgtggaaagaaataacttgatgaggttatcacagagcattccatttacacctgtgcctccaagaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttataaagaagatacagttctgcatctctgtctgagagaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgccctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttac

SEQ ID NO: 322237 - DNA, 4887 bp, Homo sapiens
  misc_feature (1)..(3): n is a, c, g, or t
  misc_feature (10)..(10): n is a, c, g, or t
nnnccgtccncagccccgtcgccggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagagcccgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatgggatagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggccaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccacctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccaataacaatacttctgaaaacactttgaaacgagcgagttctcttgctggatttactgactgtcacagaacttccattcctgttcattcagaacaagaaaaaatcagtagaaggccatctaccgaagacactcatgaagtagattccaaagcagctttaataccggtttgtagatttcaactaaacagatatatattattaaatacattaaacttttttagataagatct

SEQ ID NO: 322238 - DNA, 3540 bp, Homo sapiens
  misc_feature (1)..(3): n is a, c, g, or t
  misc_feature (10)..(10): n is a, c, g, or t
nnnccgtccncagccccgtcgccggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagagcccgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatgggatagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgttttgtggctggaagattaatttactgtcttaacataatattttggtatgtgcgtttgctagattttctagctgtaaatcaacaggcaggaccttatgtaatgatgattggaaaaatggtaagttgacagatgtttgataatactcgtgggtttattgattttttaaaaaatcacaaaaatgttattaacatagttttatttgagccagtgaatgtcttttattttgtgtttgtttgcctcatacttcacatctgccattccttaagagtttctcatgctcaatcccaatcccctatacccatttagtgctttgcaagataatgttagctataccatctatggtttatgtctgtaggtaactcctttttcctgtcttcactgatccaggctttttttttttt

SEQ ID NO: 322239 - DNA, 1080 bp, Homo sapiens
  misc_feature (1)..(3): n is a, c, g, or t
  misc_feature (10)..(10): n is a, c, g, or t
nnnccgtccncagccccgtcgccggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgaggtggtgtggactcaggtggtgtg

SEQ ID NO: 322240 - DNA, 7244 bp, Homo sapiens
  misc_feature (1)..(3): n is a, c, g, or t
  misc_feature (10)..(10): n is a, c, g, or t
nnnccgtccncagccccgtcgccggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagagcccgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatgggatagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggccaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccacctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccaataacaatacttctgaaaacactttgaaacgagcgagttctcttgctggatttactgactgtcacagaacttccattcctgttcattcagaacaagaaaaaatcagtagaaggccatctaccgaagacactcatgaagtagattccaaagcagctttaataccggattggttacaagatagaccatcaaacagagaaatgccatctgaagaaggaacattaaatggtctcacttctccatttaagccagctatggatacaaattactattattcagctgtggaaagaaataacttgatgaggttatcacagagcattccatttacacctgtgcctccaagaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttataaagaagatacagttctgcatctctgtctgagagaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgccctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttac

SEQ ID NO: 322241 - DNA, 7376 bp, Homo sapiens
  misc_feature (1)..(3): n is a, c, g, or t
  misc_feature (10)..(10): n is a, c, g, or t
nnnccgtccncagccccgtcgccggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagagcccgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatgggatagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggccaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccacctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccaataacaatacttctgaaaacactttgaaacgagcgagttctcttgctggatttactgactgtcacagaacttccattcctgttcattcagaacaagaaaaaatcagtagaaggccatctaccgaagacactcatgaagtagattccaaagcagctttaataccggattggttacaagatagaccatcaaacagagaaatgccatctgaagaaggaacattaaatggtctcacttctccatttaagccagctatggatacaaattactattattcagctgtggaaagaaataacttgatgaggttatcacagagcattccatttacacctgtgcctccaagaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttataaagaagatacagttctgcatctctgtctgagagtaagtgtcagtgaatatttaatagtggaacataatttaagctttatattttaacttctgaaatatcaataagccaaatataatcttagtttaaatattaaacaagggttctccccaccctcccttttataggaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgccctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttac

SEQ ID NO: 322242 - DNA, 7190 bp, Homo sapiens
  misc_feature (1)..(3): n is a, c, g, or t
  misc_feature (10)..(10): n is a, c, g, or t
nnnccgtccncagccccgtcgccggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagagcccgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatgggatagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggccaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccacctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccaataacaatacttctgaaaacactttgaaacgagcgagttctcttgctggatttactgactgtcacagaacttccattcctgttcattcagaacaagaaaaaatcagtagaaggccatctaccgaagacactcatgaagtagattccaaagcagctttaataccggattggttacaagatagaccatcaaacagagaaatgccatctgaagaaggaacattaaatggtctcacttctccatttaagccagctatggatacaaattactattattcagctgtggaaagaaataacttgatgaggttatcacagagcattccatttacacctgtgcctccaagaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttataaagaagatacagttctgcatctctgtctgagagaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgccctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagttttttttttaaatagaacccaaattgtgtaaaaatgttaattgggttttttaaacattgttttatcaagtcactgttaagtagaagaaagccatggtaaactgatacataacctaaattataaatacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttac

SEQ ID NO: 322243 - DNA, 5509 bp, Homo sapiens
  misc_feature (1)..(3): n is a, c, g, or t
  misc_feature (10)..(10): n is a, c, g, or t
nnnccgtccncagccccgtcgccggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagagcccgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatgggatagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggccaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccacctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccaataacaatacttctgaaaacactttgaaacgagcgagttctcttgctggatttactgactgtcacagaacttccattcctgttcattcagaacaagaaaaaatcagtagaaggccatctaccgaagacactcatgaagtagattccaaagcagctttaataccggattggttacaagatagaccatcaaacagagaaatgtaagtaagctttttcttaccattagcttgcgaagtatcatagttattgaatgttgtcttttttcctgctctttacatcatctctttaacatttctttatgagtgatgattatttattctagcatctcctctcttcacatagatgagattaggggaacaagtttattatgaattaatataaaagttaaaatttattattttcatatagttgtaccataattacaactctactaaggtcttcctaatagtgatacaattctgattttattatttagtcctgtttctaacttattcctgaataaatttgttgagagacctagtttgagactttagttttgtacttgcttgatttctctatccatcattctagtcaaaaccttgcatctgcttttggtaagcactttgatgattagagcagtaatacacagtatgcattagaaagcctgcatacaggaagatccactagaaagctgatgtggtaatccaaaaccaaaagtggaaactataggcaatctgacaggttattgtccccagaaagtaaaactttttagtacatattagacataagggtaaagacaaatctaagataatctctgtgtttccatcctaggaattagtattgtagaattccaaaggatatgcaaaaaaaaaa

SEQ ID NO: 322244 - DNA, 2761 bp, Homo sapiens
gctaaatagatcaagggactctaatactacttagagtaatgggttgaaatttagttcaattattttcaaattatatgtctgcacaatatttgcagaataacaatacttctgaaaacactttgaaacgagcgagttctcttgctggatttactgactgtcacagaacttccattcctgttcattcagaacaagaaaaaatcagtagaaggccatctaccgaagacactcatgaagtagattccaaagcagctttaataccggattggttacaagatagaccatcaaacagagaaatgccatctgaagaaggaacattaaatggtctcacttctccatttaagccagctatggatacaaattactattattcaggtcagtaatattaaaaacaaaatttaatagcattttggacctttacagatttaattatttctctctcatttttatgcagctgtggaaagaaataacttgatgaggttatcacagagcattccatttacacctgtgcctccaagaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttataaagaagatacagttctgcatctctgtctgagagaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgccctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttac

SEQ ID NO: 322245 - DNA, 1220 bp, Homo sapiens
agagatcatgtgaccagaaaatggaggcgaatctgtatttccagttaactgctcagaagagagatgctgaagagctgtagtcgtgcatccttctcaccctccgttagaaagcctcctctcatcctcagaagactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggagattcaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataaggtacagttaatgttgtcataaaataaaagtactactagtagttttaaaaaatatgtactcattgtcctaaaaacaagaattcataaactaagagtacccagggaaatatatttgtctctgtctttcctagaaaggtgctttggactattcatcaagaatcccgaattaagagagaaaatgctgtcatgatgaatatttcccccagatcattataaaacaggacctctaaattgcttgctataaacacggaagatgaagtggtgggattttcatgccacattagaaaggagaatagataataca

SEQ ID NO: 322246 - DNA, 424 bp, Homo sapiens
gatgaagagagatcttataagagaagtgtgagactggatgaagaactgagggaagcatcagaggcagctaaaactagctgcctttacaatgatccagaaatgtcttctatggagaaggatattgacttgaagctgaaagaaaagccttagttggcctctctgtccaccttccagcaaatgtggattagcaagcaagagtacgatgaggcaggcccatccattgtccaccgcaaatgcttgtaagatgccttctctctccatctaccttccagtcaggatgacggcattatgcttattggagtcttccaaaccaccttccctgatctttcatcaatcattgtacagattgtttacacacgtgcaatttgcttgtgcttctaatatttattgctttataaataaaccagaccaggacttgcaacct

SEQ ID NO: 322247 - DNA, 4328 bp, Homo sapiens
agagatcatgtgaccagaaaatggaggcgaatctgtatttccagttaactgctcagaagagagatgctgaagagctgtagtcgtgcatccttctcaccctccgttagaaagcctcctctcatcctcagaagactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggagattcaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaaactggatgaagaactgagggaagcatcagaggcagctaaaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatagtcttcatatgccctttaaaatgccaacaagatttcaagtctgtaggcctctagtgaggtggggtggcaaaccacagctaagtctcgctcaccactgcaagctaagaatggtttttacattttgggttggaaaaattttttttgaatatttcatgacacatgaaaattattcaaatgttagtgccgataaataaagtggtactgaaacacagccacacaaacttgtttttgtactgtctacagctactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttggtaaataaattctccataatgtagattaataatataaaagtctttaatgacacaatatatctatatagcctcactgtataattcagaaataaaaattgattctgca

SEQ ID NO: 322248 - DNA, 3694 bp, Homo sapiens
gttgaggtcaacctaatttgcaactgaaacctactaaaccagatacatccctgacttggcccaggctgcaagctaacttgaactgtacccaccagactgacgtggatgttttcagctttattcagccagcatgtttctgatccctttgcaacttatgtctacattttatgaaggaatttgcaaagtaaatgtacataaacactgaatgggaggcaatgacaacatatttaatggaaggagtacgtctcagggctccagaagacagtttcgaaaagcacatatgcaccactttcatttggccctgctttgctgagtgactgtctcatgctgtgcttgcttctcttttgtttcttttccacaccaataatttttgctcctgcagactggatgaagaactgagggaagcatcagaggcagctaaaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatagtcttcatatgccctttaaaatgccaacaagatttcaagtctgtaggcctctagtgaggtggggtggcaaaccacagctaagtctcgctcaccactgcaagctaagaatggtttttacattttgggttggaaaaattttttttgaatatttcatgacacatgaaaattattcaaatgttagtgccgataaataaagtggtactgaaacacagccacacaaacttgtttttgtactgtctacagctactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttggtaaataaattctccataatgtagattaataatataaaagtctttaatgacacaatatatctatatagcctcactgtataattcagaaataaaaattgattctgca

SEQ ID NO: 322249 - DNA, 3372 bp, Homo sapiens
gatttttctattataagaaacttgcatgatttaaatattttcagtatgtcctttgaggaaaaaagcaaacacagtgctacccaaatcattactaaatgtctctcatttggtttctcatgtttctctctctttttcttttctttgcagtattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatagtcttcatatgccctttaaaatgccaacaagatttcaagtctgtaggcctctagtgaggtggggtggcaaaccacagctaagtctcgctcaccactgcaagctaagaatggtttttacattttgggttggaaaaattttttttgaatatttcatgacacatgaaaattattcaaatgttagtgccgataaataaagtggtactgaaacacagccacacaaacttgtttttgtactgtctacagctactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttggtaaataaattctccataatgtagattaataatataaaagtctttaatgacacaatatatctatatagcctcactgtataattcagaaataaaaattgattctgca

SEQ ID NO: 322250 - DNA, 5599 bp, Homo sapiens
gctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaataccagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaggcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttagcactagaggaagcctctggtccagtcagccaatcacagaagagtaagagccgaggcagggctggcccggatgcagttacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggagattcaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaaactggatgaagaactgagggaagcatcagaggcagctaaaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatagtcttcatatgccctttaaaatgccaacaagatttcaagtctgtaggcctctagtgaggtggggtggcaaaccacagctaagtctcgctcaccactgcaagctaagaatggtttttacattttgggttggaaaaattttttttgaatatttcatgacacatgaaaattattcaaatgttagtgccgataaataaagtggtactgaaacacagccacacaaacttgtttttgtactgtctacagctactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatctacaggcccagagatgggccccttaaacttttatatggccacttaccttataaccagagggaccacacggatgtcccaaaaagggctgaccctggagaaacccacccagagcaaaacaacccacgcaccaatacccgcacagaccgctccacaggggcgccctctcc

SEQ ID NO: 322251 - DNA, 2404 bp, Homo sapiens
gctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaataccagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaggcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttagcactagaggaagcctctggtccagtcagccaatcacagaagagtaagagccgaggcagggctggcccggatgcagttacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatggtaagtcactaagttggcaaggccaaagttaaatgctaaataagtaaaagattttctaacagacctctcatttttgtgccagtggatcctttttgtgatttctagaagcttctgtttttatttcaggttataggtggccatgattgacagtttggagcctgacagagaaagtatgggtcacagaggccatacataaccattgctctttattaacccccactctgtgctagcatttatgctaggcactggggctgagggaagactgttacatgctgtgttacaagaaacctggggctgggtttgcaggggaagagaatttaatcaggatgataaaatttgaagaagagaaatcagagcttgccaatttcttgtataagttcccactatctgcaatgttcttttccccagatccttacgtgactgactccttctctttattcagatgttaatcagatgtcacctcctcagagaagtcttccttgacctctgtaatcaaagatgcttcccacttcccgactcccaccacctagtcactctctgtcccagtgttcattttattttccacgtatcactaattcaaattgtattatttaactatttgtttgcatctttattgtctttctcttaccactcgaatgtatgctccacaggagc

SEQ ID NO: 322252 - DNA, 2085 bp, Homo sapiens
gctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaataccagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaggcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttagcactagaggaagcctctggtccagtcagccaatcacagaagagtaagagccgaggcagggctggcccggatgcagttacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggagattcaggatactatggggacggtctaaatgccatcattgtgtttgccgcctgttttctgccagacagcagtcgggcggattaccactatgtcatggaaaatcttttcctatactgtcataagtactttagagctgtgggtgcacagatcctctagagc

SEQ ID NO: 322253 - DNA, 5666 bp, Homo sapiens
gctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaataccagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaggcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttagcactagaggaagcctctggtccagtcagccaatcacagaagagtaagagccgaggcagggctggcccggatgcagttacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggagattcaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaaactggatgaagaactgagggaagcatcagaggcagctaaaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatagtcttcatatgccctttaaaatgccaacaagatttcaagtctgtaggcctctagtgaggtggggtggcaaaccacagctaagtctcgctcaccactgcaagctaagaatggtttttacattttgggttggaaaaattttttttgaatatttcatgacacatgaaaattattcaaatgttagtgccgataaataaagtggtactgaaacacagccacacaaacttgtttttgtactgtctacagctactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttggtaaataaattctccataatgtagattaataatataaaagtctttaatgacacaatatatctatatagcctcactgtataattcagaaataaaaattgattctgca

SEQ ID NO: 322254 - DNA, 453 bp, Homo sapiens
tcagttaataaaagaagacttcattgagtgtactttatatggtcaggatagtgctaagctctgtaaaggctgtacaaaacaaggactttgatcaggttgtttctgcaggatgaaacaaaacaaaggctgcccgtaggagtactgtattgtaaagcttaccatttggctgtttagctgcactgtggaggtcttgctccttcagccttgctctgtgctttgtttccagaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggagattcaggagattcaggtaaccttctctgaagtcttgctggacaaatgacc

SEQ ID NO: 322255 - DNA, 2796 bp, Homo sapiens
gctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaataccagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaggcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttagcactagaggaagcctctggtccagtcagccaatcacagaagagtaagagccgaggcagggctggcccggatgcagttacccatgacaatgaatgggaaatgctttcaccacagcctgttcagaaaaacatgatcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttggtaaataaattctccataatgtagattaataatataaaagtctttaatgacacaatatatctatatagcctcactgtataattcagaaataaaaattgattctgca

SEQ ID NO: 322256 - DNA, 2820 bp, Homo sapiens
gctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaataccagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaggcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttagcactagaggaagcctctggtccagtcagccaatcacagaagagtaagagccgaggcagggctggcccggatgcagttacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggagattcaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaaactggatgaagaactgagggaagcatcagaggcagctaaaactagctgcctttacaatgatccagaaatgtcttctatggagaaggagtaagaattcaccatcaataacagctatgtggttacttgtagtgttgtatggctgggctctgaaagaaaacacactgaggactgggtaaaccctgtttagatgttcagctttcctgtgctccattcctgaaattagaaacctgaagctatatttgccagcttcacaccatttcattcacgatcaccccttaaatttctaaaggacaacctgtggacatggcattctatttttccaatccaaaaatgggaagaaaatgaatattaggaccagatgtaagaacatttgggcaagaggaatgcaattctgctttctgaatgacatcatctctattttaattagtggaagttgggaacttccatttaatactttggtggatgg

SEQ ID NO: 322257 - DNA, 2558 bp, Homo sapiens
gctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaataccagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaggcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttagcactagaggaagcctctggtccagtcagccaatcacagaagagtaagagccgaggcagggctggcccggatgcagttacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggagattcaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataaggtacagttaatgttgtcataaaataaaagtactactagtagttttaaaaaatatgtactcattgtcctaaaaacaagaattcataaactaagagtacccagggaaatatatttgtctctgtctttcctagaaaggtgctttggactattcatcaagaatcccgaattaagagagaaaatgctgtcatgatgaatatttcccccagatcattataaaacaggacctctaaattgcttgctataaacacggaagatgaagtggtgggattttcatgccacattagaaaggagaatagataataca

SEQ ID NO: 322258 - DNA, 1807 bp, Homo sapiens
  misc_feature (120)..(120): n is a, c, g, or t
ggcttagggtcaggggtctgcccggtgcttcttgtacgttggctccagatggggtaaacagctggtggtgtccccccaccaccaccaggtgcctcaaccaccacgacgacgacgacgtcntcgtcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttagaagcagact

SEQ ID NO: 322259 - DNA, 745 bp, Homo sapiens
gtcctttcccatgctgtcttcatgatgggaagtactggcgattctctgagggcagggggagccggccgcagggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttagaagcagact

SEQ ID NO: 322260 - DNA, 1779 bp, Homo sapiens
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttagaagcagact

SEQ ID NO: 322261 - DNA, 1537 bp, Homo sapiens
  misc_feature (1427)..(1427): n is a, c, g, or t
  misc_feature (1436)..(1437): n is a, c, g, or t
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctctgccctcaaaccgtgtancccacggtnnccaaatgttaacccctgatacgcctcacatttggccccaactgttcccttattagttgcttccgggaaccatcattgctggacttttaaggtccctttga

SEQ ID NO: 322262 - DNA, 944 bp, Homo sapiens
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggaggaaaggcgtgtgccaggagcccgtccttcccgtcgaagggatacccgtctccgtgctccgcgacaccaaactggatgacgatgtc

SEQ ID NO: 322263 - DNA, 494 bp, Homo sapiens
atcccccgcgcggccccctcagctgaagcagccggggaagtccatctccaactgggaggtgatggagaggctgaagggcatggtgcagaaccaccagttctccacgctgcgtatttccaagagcaccatggacttcatccgcttcgagggggaggtggagaacaagagcctgagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttagaagcagact

SEQ ID NO: 322264 - DNA, 498 bp, Homo sapiens
ggcagggggagcccgggcgccgtcggtccgtccgctagccggctcagcacctgtctcctccgcgcctgcccgcaggttcgacgtgaaggcgcagatggtggatccccggagcgccagcgaggtggaccggatgttccccggggtgcctttggacacgcacgacgtcttccagtaccgaggtgagggctgaggaggatcccttcgtgagacaccacactaagctcctcttagtgagtggtcaaattctgagcgaggaagaaaaagcccttggaaatggaaacaaatgccccagcacagacaagatcccagcagaggcagaggccttctccaggtcatttaggaagtcagggatgcaaccaagaccaggacccagatttcctgcctccccggctggaagctctttctccttcagtacaggacggcaggtggtttgtatggaagctcagttattagacaacagtcatcaagtgccgataatgtgccaggcactgtgctaca

SEQ ID NO: 322265 - DNA, 2346 bp, Homo sapiens
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttagaagcagact

SEQ ID NO: 322266 - DNA, 2173 bp, Homo sapiens
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttagaagcagact

SEQ ID NO: 322267 - DNA, 2000 bp, Homo sapiens
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttagaagcagact

SEQ ID NO: 322268 - DNA, 1420 bp, Homo sapiens
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgtcctgaacctgagccacggcctccaaccaccacgacgacgacgggatcctctagaacacctcac

SEQ ID NO: 322269 - DNA, 492 bp, Homo sapiens
agcccgggcgccgtcggtccgtccgctagccggctcagcacctgtctcctccgcgcctgcccgcaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttagaagcagact

SEQ ID NO: 322270 - DNA, 392 bp, Homo sapiens
  misc_feature (15)..(16): n is a, c, g, or t
aattcggcacgaggnntggctgaggagccaatggagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggta

SEQ ID NO: 322271 - DNA, 668 bp, Homo sapiens
tccttttctttaaggatttaactatcaacttgataaataacttataggtgatagtgataattcctgatttcaagaagcaggaactggccagttcctgcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcaagaagcaggaactggccagttcctgcttcttgaaattctataaagcggaactgaaaatgttgctagaggatgggtgtgtgggagtggaggaaggcagctgacatatggaaatggggaaaataccatcagaaccctaggaaacatcagccaagggcaacgcctcgaacccctttgaaaccctcccggattcactggtctccatttagcctttgtgtttcagaagcgaaaatggggtgcgcgctc

SEQ ID NO: 322272 - DNA, 363 bp, Homo sapiens
aatggcttggttggctctatgttactgatcccaacctagagtaagcagattatccacgactgattttattcctactttattctccatgtaaataagtaaacttacttgacatttaaatgttagttgattctgtacaacagtttgtcagtctgggagtggggggtggctcccaagccacagataccaaaaataccatgtgtttgatcctttgtgttctaacagctttttaatggcatcttatgtgctacataaagtcactctagatagatttgaccaccactgctctctcaaatgtctacttaaggtggctatcacagaacattgacctaaaaaaaaaatgactggtaccacagaggtggtttt

SEQ ID NO: 322273 - DNA, 12590 bp, Homo sapiens
aaatacatcgcaccaccaaactaacactcgcacacacccccgcggttactccgtgtcaaactcctagaggagcccttggccagctcggggtgcggcggtggcgaccggcaggcgaggaggcccgcgggcagcaggtattgatgtcaagctgaaccatcgtaggaagttgaaagccttagaaagaggacttggtaaagtttttggattatcttgaaactcttgcatatggcatggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322274 - DNA, 12428 bp, Homo sapiens
  misc_feature (12410)..(12410): n is a, c, g, or t
aaatacatcgcaccaccaaactaacactcgcacacacccccgcggttactccgtgtcaaactcctagaggagcccttggccagctcggggtgcggcggtggcgaccggcaggcgaggaggcccgcgggcagcaggtattgatgtcaagctgaaccatcgtaggaagttgaaagccttagaaagaggacttggtaaagtttttggattatcttgaaactcttgcatatggcatggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaatatctctgctgcaaatagacacccttgccccccaacccacccaacctattctaaaataatagcaatttctaactttaagcctccttctggccagancccagctaaagagaccca

SEQ ID NO: 322275 - DNA, 10798 bp, Homo sapiens
aaatacatcgcaccaccaaactaacactcgcacacacccccgcggttactccgtgtcaaactcctagaggagcccttggccagctcggggtgcggcggtggcgaccggcaggcgaggaggcccgcgggcagcaggtattgatgtcaagctgaaccatcgtaggaagttgaaagccttagaaagaggacttggtaaagtttttggattatcttgaaactcttgcatatggcatggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggta

SEQ ID NO: 322276 - DNA, 12549 bp, Homo sapiens
cagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcaggtaaggagccaacggtctggaaagtggaggaattctatgtgcagttccagagttaaggagggcttctcgtatcatgaactttaagttaatgctgccctgattaacttcctgtgaggatgttcatcttcagtgagttgtgtgaccgtattttctcttccttagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322277 - DNA, 10960 bp, Homo sapiens
tgagacagatagaatcgagctggtaccgggcattatagtcgatattctgcactgtaagagcgtcccatcgtagctattcagaagggtcatctggttcgcgtgaatctcaaattcctcttcgtctgacagagttcctctgtgtcatcagttggttgcctgcccgcaggacgctgcccacactgctccggtgtgcacgctcacgctcccaccatacaacgctccatgggtcgcaaactggtctttgacttcttcaacatcatccgaaatatcatcctgctcctggaaagtgtcctcagcagaaagcaaccaggtcagcacttcctccaacgcaatctgatagctgtccagatccatgtcaacctcagtgacagtgctgggagtttcagatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322278 - DNA, 10830 bp, Homo sapiens
ccacactctgggatataaacccgcccatctgtgaagctgattgcagtttgctgtgaaccttgctacttgtacttggttgaagttctaggtacctttagtcaagggatggaaaaataaagccatacgcagttttgttacctcagttaccccaaaaataggaaaagcagcaagcacagtattttaaagatcataattcctataaaaggactgtgcaccaagtgtttagactccattttcattaggcaggttgactaaaaatgattgcagtaacaggtttatataaaatagagcaacctttcatgctgtgacacaaatcaaaaggttgataactttgtaattttactctggagattctaaccgaagttggtgtaagttttcaagagttactaaaatcaagttggaaatgatttacgtacacttccctgagcctggactaaagcctcatgcctgtaccccaagtaggtgatggtacttttctatacaaaaaggatttcctggcaggcaggtatttacaaagtttgttcctgtaccagtcccataatgacaactctaaatccagctgcaccaatcttagtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcaggtaaggagccaacggtctggaaagtggaggaattctatgtgcagttccagagttaaggagggcttctcgtatcatgaactttaagttaatgctgccctgattaacttcctgtgaggatgttcatcttcagtgagttgtgtgaccgtattttctcttccttagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322279 - DNA, 6669 bp, Homo sapiens
cggcccaaaaggccagtcttagtcctatcaggaaccccttccgccacccccacacccccactggcccaacagcattgggtttatttccaggcagctggtgagcagggttgagaacttgccccaggtgacaagtctcccagctgagaacgcaagctgatctccagttcctcggctctcccatgcagcatgcagcagcattccacctccttcaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322280 - DNA, 12348 bp, Homo sapiens
cagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagaccccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322281 - DNA, 12293 bp, Homo sapiens
cagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322282 - DNA, 5713 bp, Homo sapiens
gatatgggccagaaatttgggtaccctcctctagaaagaaattccagtaatggatctgtttaagtgttaagggagcagaagagaagacggtgaatgtacttcaatattttgaacatttttagaaataggaattcttgagtctcttttctttcttcagtcttttccatttctttttcttttctttttcactgtaatttctgtgcccatttcattgaaatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322283 - DNA, 3331 bp, Homo sapiens
agcggagaagattatgaagcaacaacactagctacagtttaaatgaaggcatttcttcacttttaatatatttcttttttcaccagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagaccccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322284 - DNA, 3171 bp, Homo sapiens
gtgaagtagagtgagcattagcctggcagacagctagggtaatagatgacttccagtggaagtcaaagcacaaatgttggaagaagaagaatggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagaccccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322285 - DNA, 2583 bp, Homo sapiens
atgaattcacttaacattaaaacaacagaaaaattgagggataaaaatggtgttgataaatgagtctggcagcataaccaagtggattcttcaaggtgtccaagcggaaagagaaggaccaaagcccccaccaagctgatgctaaaatgtatggaaaacatctgaaggcaaagacttctatatgatttaattatccatggtgagggcggggaagttaaaaaggaaatgtttttccttatgattatttgaatcctttctctgctttaacctctgaatgtggttccagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322286 - DNA, 10541 bp, Homo sapiens
cagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgccgtgagtatgaaagattgcagcaccacagctgcacgtgttccttccctttctctttttctgcatgcggcccttcgccttcttccttaagataacaaaaaccttattacaaacaggactgaatattatttgaaaataaggcaaacattatataagaaaatgagaaagggaaggcacacgcgcagctgtggtgctgcatctttcatactcacggcagcagatggaaacgtgctgtgaatctgctccatg

SEQ ID NO: 322287 - DNA, 7269 bp, Homo sapiens
cagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccatttcatttgaaatgggccccgattttataacaggcgagtaaagtatttcttcggaaaacatttcatcagaccatatgttaaaaagactttccttttgttcaactggatta

SEQ ID NO: 322288 - DNA, 7287 bp, Homo sapiens
cagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccatttcaatgaaatgggcacagaaattatttgggctatgtggagcaagctgtcttgcataaaaagctatattgggctctagagaaagtgagaatggaaagaatttgagagatacgtgagaccaaaaaaaa

SEQ ID NO: 322289 - DNA, 7277 bp, Homo sapiens
cagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccatttcaatgaaatgggcacagaaattcagtacctgcttagacagcatcggtttggctgagctgagggatcataggagtgctttttatggtgttgaatttctttgaaaatttctttagaa

SEQ ID NO: 322290 - DNA, 6753 bp, Homo sapiens
cagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcaagaagcaggaactggccagttcctgcttcttgaaattctataaagcggaactgaaaatgttgctagaggatgggtgtgtgggagtggaggaaggcagctgacatatggaaatggggaaaataccatcagaaccctaggaaacatcagccaagggcaacgcctcgaacccctttgaaaccctcccggattcactggtctccatttagcctttgtgtttcagaagcgaaaatggggtgcgcgctc

SEQ ID NO: 322291 - DNA, 613 bp, Homo sapiens
gatatgggccagaaatttgggtaccctcctctagaaagaaattccagtaatggatctgtttaagtgttaagggagcagaagagaagacggtgaatgtacttcaatattttgaacatttttagaaataggaattcttgagtctcttttctttcttcagtcttttccatttctttttcttttctttttcactgtaatttctgtgcccatttcattgaaatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccatttcaatgaaatgggcacagaaattatttgggctatgtggagcaagctgtcttgcataaaaagctatattgggctctagagaaagtgagaatggaaagaatttgagagatacgtgagaccaaaaaaaa

SEQ ID NO: 322292 - DNA, 792 bp, Homo sapiens
tatcttaaataagatgcctttacttttgtggcaggataagctggcctaagctgaagtctccaaaaagaaaggaggacagaaaaagaaattggtgaaattttttttgtatgaaaacatacctgtggtgcaaaaataatagatttctcattcaaacactgaaataataagaccatattacttgtttttcagtctcatatttttcagtcccctggtgtgtggattctttctacacaaacaaacagctagtacgtgtcaattatgtaaaattatattaccaacactcaagcaaaaatgttttgggtatattcccctaaaattgtcctttgcaatgggaaatcttttcacattgatatttagaggctggttggagtatttcctcctgaatttgggttttagtggaaggctagacattaatttgagaagctttgttgttctctttatttgctgtcacagcgggagaggacctgctggccccaccgcacgacaccagcacggatctcacggaggtcatggagcagattcacagcacgtttccatcttgctgccgtgagtatgaaagattgcagcaccacagctgcacgtgttccttccctttctctttttctgcatgcggcccttcgccttcttccttaagataacaaaaaccttattacaaacaggactgaatattatttgaaaataaggcaaacattatataagaaaatgagaaagggaaggcacacgcgcagctgtggtgctgcatctttcatactcacggcagcagatggaaacgtgctgtgaatctgctccatg

SEQ ID NO: 322293 - DNA, 809 bp, Homo sapiens
  misc_feature (728)..(728): n is a, c, g, or t
  misc_feature (773)..(773): n is a, c, g, or t
  misc_feature (798)..(798): n is a, c, g, or t
cagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgacttggaaanatgtttgccggttcaaccttcccttgaacaaagaaaatcccattnaaatttattgttattttaaaccatncttttggtttt

SEQ ID NO: 322294 - DNA, 768 bp, Homo sapiens
aaatacatcgcaccaccaaactaacactcgcacacacccccgcggttactccgtgtcaaactcctagaggagcccttggccagctcggggtgcggcggtggcgaccggcaggcgaggaggcccgcgggcagcaggtattgatgtcaagctgaaccatcgtaggaagttgaaagccttagaaagaggacttggtaaagtttttggattatcttgaaactcttgcatatggcatggccaagtatggagaacatgaagccagtcctgacaatgggcagaacgaattcagtgatatcattaagtccagatctgccctctcctactacaggagagagagataatggccctttgctcctcattccgcattcagaccagattccccagctgcaatctcctgccatcggattgcatcaccaactcaacctaattggtgagatgtcactccctccctccaccgctcactctcatttctcagtgagtttagctctgtcactctctctaaaagttactcttgttttagtgatttgggtgtaaacattgatgatccttctaatactctgtcctcttaatttctctaagttctctttctagtgatcttgtctcccagtgtggtgggtatattctggctagaccaggtcattgtttatggtggcagcccctctgtcatctgaatttaagcgtcccattttttcggtactagcatggctcactgcaacctccgcctcctgggctccagcaatcctcccaccctcgggtagctggggctatagg

SEQ ID NO: 322295 - DNA, 210 bp, Homo sapiens
tgacatcaaaagaaatttctttgtcaaagtgtagacatgtttgttgtgactgccttttgtgtgggttcttttctcccagccctctcctactacaggagagagagataatggccctttgctcctcattccgcattcagaccagattccccagctgcaatctcctgccatcggattgcatcaccaactcaacctaattggtgagatgtcact

SEQ ID NO: 322296 - DNA, 477 bp, Homo sapiens
aaatttcggttcgtgtctgcttctccaagctttatttttttttttaaatacatcgcaccaccaaactaacactcgcacacacccccgcggttactccgtgtcaaactcctagaggagcccttggccagctcggggtgcggcggtggcgaccggcaggcgaggaggcccgcgggcagcaggtaagcccatgcattattgaagcctcgggctggtaatgtgactacagcccccgagggaatggggcgggggccgggaggaggatggctctttctgtggttcttccgcctgggatcggcgtcccgagctgcttcccaagtcccagagtcgaagatgggagtaacttttgcgtgccctttcctcggggcctcagtttagctccccgcggtgcgagagagaatgccggaggcgtggagagctcgggcgtggaggtccttgggatccgtactagttgtgaacgatccaaacttatctgaccag

SEQ ID NO: 322297 - DNA, 360 bp, Homo sapiens
agctaaaacttgacattgaacacattaacatttgtttatttgggggaatggcttttcctttgtagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaaggtgaggcggggacgaccagtgccaacaggcttcatgcctccctcctccctttaaaaccagcacatcaatcatctgtctatctgtcaaacactatgtgcatgtagcatctttcacagtaggtttt

SEQ ID NO: 322298 - DNA, 412 bp, Homo sapiens
aaagtaacaggactgccattaagtgatttcttttgttttctctttcagcaaatgttcccagcaggccacaggtaagagttaatggcttggttggctctatgttactgatcccaacctagagtaagcagattatccacgactgattttattcctactttattctccatgtaaataagtaaacttacttgacatttaaatgttagttgattctgtacaacagtttgtcagtctgggagtggggggtggctcccaagccacagataccaaaaataccatgtgtttgatcctttgtgttctaacagctttttaatggcatcttatgtgctacataaagtcactctagatagatttgaccaccactgctctctcaaatgtctacttaaggtggctatcacagaacattgacctaaaa

SEQ ID NO: 322299 - DNA, 593 bp, Homo sapiens
gatatgggccagaaatttgggtaccctcctctagaaagaaattccagtaatggatctgtttaagtgttaagggagcagaagagaagacggtgaatgtacttcaatattttgaacatttttagaaataggaattcttgagtctcttttctttcttcagtcttttccatttctttttcttttctttttcactgtaatttctgtgcccatttcattgaaatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccatttcaatgaaatgggcacagaaatttcccatgtatttcccccacacaggcacagcctccctcatcatcagcatcccccaccagagtggatgttgaacaggtgccggcc

SEQ ID NO: 322300 - DNA, 12536 bp, Homo sapiens
aaatacatcgcaccaccaaactaacactcgcacacacccccgcggttactccgtgtcaaactcctagaggagcccttggccagctcggggtgcggcggtggcgaccggcaggcgaggaggcccgcgggcagcaggtattgatgtcaagctgaaccatcgtaggaagttgaaagccttagaaagaggacttggtaaagtttttggattatcttgaaactcttgcatatggcatggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaatattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322301 - DNA, 11965 bp, Homo sapiens
  misc_feature (11763)..(11763): n is a, c, g, or t
  misc_feature (11768)..(11768): n is a, c, g, or t
  misc_feature (11965)..(11965): n is a, c, g, or t
aaatacatcgcaccaccaaactaacactcgcacacacccccgcggttactccgtgtcaaactcctagaggagcccttggccagctcggggtgcggcggtggcgaccggcaggcgaggaggcccgcgggcagcaggtattgatgtcaagctgaaccatcgtaggaagttgaaagccttagaaagaggacttggtaaagtttttggattatcttgaaactcttgcatatggcatggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacaaaaaaaaaaaaaaaaanaaaanaaattggttactgagaaagggagacgtttttcaagttcatccatcctttcttggaacagagcgcaaagaggatgtgttgcagaaggacggtgagagtgaagattctcaaggacaacatcaagttattagctgccaggtgccctctgtggccaggagtgacgtctgagctgaatgttgtgctagaagccaggccgccn

SEQ ID NO: 322302 - DNA, 12387 bp, Homo sapiens
cagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322303 - DNA, 9252 bp, Homo sapiens
cagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcaccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322304 - DNA, 7195 bp, Homo sapiens
cagaggacccccaacgtacagcagtctatccaaggataggaacttagaaacggtgtctcaacgtatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322305 - DNA, 6302 bp, Homo sapiens
tccttttctttaaggatttaactatcaacttgataaataacttataggtgatagtgataattcctgatttcaagaagcaggaactggccagttcctgcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322306 - DNA, 6035 bp, Homo sapiens
agtcggaaaaattaacttcggtacggtaacaattcgacaggttcagcaataaaaaagcgctgtcggcgtgttaatcatcaatcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322307 - DNA, 3370 bp, Homo sapiens
agcggagaagattatgaagcaacaacactagctacagtttaaatgaaggcatttcttcacttttaatatatttcttttttcaccagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322308 - DNA, 2898 bp, Homo sapiens
gacttttgtctccctctcccctctttgcagtcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaactataaaacttcagctgg

SEQ ID NO: 322309 - DNA, 9417 bp, Homo sapiens
cagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacaggtaagcatgaaggatcactggtgtgtaggatgtgttggcgaagggttttgaggatgttctgagacatggaatagggaactcgggctggagccaaatactggaagactttgggtaccatccaacaagtggtgtattttatttcctaaggctcatttgcttcaaaaaatagcaacccttgcaaagagacttgctgtttttctttgataaaatctacaatctttaacctgtgccattagattgctgtttgtcctgcccttttcctggcctcatctcctaccattcctctccttgctctccgctttccagctgcactg

SEQ ID NO: 322310 - DNA, 8841 bp, Homo sapiens
cagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacatgggcacagaaattgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgtgcccaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaagtaagttgattttaattctcctttatgataccaagaaaatcatgttttattgataacttaagaggcttctctccccataacttttaaaaatagaattcagtcctattatctgaaagaaactgtgatatagttaatattaaaaagaaactacttttaacatgagaattatatttttcatgtatcagattagggatataggtgtgtttagctgatatattttaaagtagagatttaaatatttggagacagacaataagctatgatggccatactgtattccagcctggacaacaaagcaagatccagtctctaaaaagtaaa

SEQ ID NO: 322311 - DNA, 6541 bp, Homo sapiens
cagatgtaggtgatgagcggcctggcagccaccacgtttcattggaaaaagtgcagattggatttgccagggcatgtagctctccaggcttgcaagcgattaccagatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggtcgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagagtgcccagattgaggaagttctacaaagaggagaagaaatgttacatcaaccatgaaatcgggccgagctcgattcgc

SEQ ID NO: 322312 - DNA, 655 bp, Homo sapiens
aaatacatcgcaccaccaaactaacactcgcacacacccccgcggttactccgtgtcaaactcctagaggagcccttggccagctcggggtgcggcggtggcgaccggcaggcgaggaggcccgcgggcagcaggtattgatgtcaagctgaaccatcgtaggaagttgaaagccttagaaagaggacttggtaaagtttttggattatcttgaaactcttgcatatggcatggccaagtatggagaacatgaagccagtcctgacaatgggcagaacgaattcagtgatatcattaagtccagatctgccctctcctactacaggagagagagataatggccctttgctcctcattccgcattcagaccagattccccagctgcaatctcctgccatcggattgcatcaccaactcaacctaattgataagaggtttcaccatgttgcccaggctggtctcaaactcctgggctcaagcaatccatccacctcagcctcccgaagtgttgggattacaggtgtgagccaccatgcccggctgactttgcctactcttgccctaagaaaattgaagcaaaccaaagaggaatccagaaacttcaataccacatctatcctcaaccagaacccacccttggccttgccatatgcaa

SEQ ID NO: 322313 - DNA, 828 bp, Homo sapiens
accgagtagctaccttataaagaccatctgtacatccactgtgaaatggagtttcaaaatcacaagcttctttcccacatgaacataagactaggagcacatatggaagagtaaagttgaagggaatttggatgatgatttggcaagatgctgtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagcttatccagtgggctgcgaaaaggcaccaaaaagtacccggactatatccaaattgctatgcccactgaatcaaggaacaaatttccactagagtggtggaaaacgggcattgccttcatatatgcagttttcaacctcgtcttgacaaccgtcatgatcacagttgtacatgagagggtccctcccaaggagcttagccctccactcccagacaagtttttgattacattgatagggtgaaatgggcattttctgtatcagaaataaatgggattatattagttggattatggatcaccc

SEQ ID NO: 322314 - DNA, 855 bp, Homo sapiens
tgtggcattccagagctgctccctttacggaagggaagacttggtttctcagcgaaaataaggggcggggaacccctgtcaacatccatccagagagctgcatcctgtggccctataacactcttctccaaaaggacctgccagagactgggagtgttgactgctgcaaggaccaaggtgtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagcttatccagtgggctgcgaaaaggcaccaaaaagtacccggactatatccaaattgctatgcccactgaatcaaggaacaaatttccactagagtggtggaaaacgggcattgccttcatatatgcagttttcaacctcgtcttgacaaccgtcatgatcacagttgtacatgagagggtccctcccaaggagcttagccctccactcccagacaagtttttgattacattgatagggtgaaatgggcattttctgtatcagaaataaatgggattatattagttggattatggatcaccc

SEQ ID NO: 322315 - DNA, 1104 bp, Homo sapiens
accgagtagctaccttataaagaccatctgtacatccactgtgaaatggagtttcaaaatcacaagcttctttcccacatgaacataagactaggagcacatatggaagagtaaagttgaagggaatttggatgatgatttggcaagatgctgtaagtggattaggcaaggctgctaaagagagacaggaaatggctgtgttagtgcttcggacctccgttagaagtagcagttcatggtgttgaaggtttgttgttgaaaataccttcctgaggcacctcttcattgtgcttattcttcccacaacattgtgccaagacactgtcaagcctgggcctgtcaaagcctgggatgtcaaaggcctgggtctttctcatcctgctgtaatgtattgatagctgggggctctgcagaaggacaagggaaaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagcttatccagtgggctgcgaaaaggcaccaaaaagtacccggactatatccaaattgctatgcccactgaatcaaggaacaaatttccactagagtggtggaaaacgggcattgccttcatatatgcagttttcaacctcgtcttgacaaccgtcatgatcacagttgtacatgagagggtccctcccaaggagcttagccctccactcccagacaagtttttgattacattgatagggtgaaatgggcattttctgtatcagaaataaatgggattatattagttggattatggatcaccc

SEQ ID NO: 322316 - DNA, 2243 bp, Homo sapiens
cgtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagatgctgctcagactctcgctctcgcacaggatcacagtatggatattccaagtcaagaccaactgaagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattcagttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttgtgtcaccccaaaacactcccttctgcccctcttcagacagtccttcagctatttcatggctctcaccctagtttttttttttttttgcacttttttttttccgggggtataggggaggtgtggggcgacagggtctgtcttgttctgtctcccaggctgaagtgcagtgagtcaagattgagccactgcactccagcctgggtgacagcgcgagactccatctcag

SEQ ID NO: 322317 - DNA, 382 bp, Homo sapiens
gggactacaagcgtgcctcaccacacctggctaagttttgtatgttatgtagagacaggttttgccatgttgcccaggctggtatcaaactcctgggttcaagcaatttgcctgccttggcctcccaaagtgctgggattacaggtgtgaaccacttcagccgactaaatttttatttgataaacacttggattttatgttttgtccacttacaatgctgatggctcttattaaacattgtacttcatttgccaaaaagaattattatgtgaacacatatcaaaagcctaaagtcgtttatgtgccctggactgggaaaatatttttataatccaggcaaattacttctagtaatagaatagacttctttatttggacgtct

SEQ ID NO: 322318 - DNA, 3939 bp, Homo sapiens
cgtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagatgctgctcagactctcgctctcgcacaggatcacagtatggatattccaagtcaagaccaactgaagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattcagttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttgtgtcaccccaaaacactcccttctgcccctcttcagacagtccttcagctatttcatggctctcaccctagtttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagttttttttttttttgagagacggtctcgctttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgttgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctcttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaa

SEQ ID NO: 322319 - DNA, 3871 bp, Homo sapiens
cgtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattcagttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttgtgtcaccccaaaacactcccttctgcccctcttcagacagtccttcagctatttcatggctctcaccctagtttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagttttttttttttttgagagacggtctcgctttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgttgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctcttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaa

SEQ ID NO: 322320 - DNA, 3643 bp, Homo sapiens
actgtgctagctgggaaggatataaagattttataccatagttggcatattgtttgtgcttcctggatcctgccctcaaatagttcagaccaaaagaatgtaaacccagttatagaatgaggtaaaaatttaatcatcaatatatgtacaggattaagaagtactatagaggtgatttattctgtcagggtcagcttaacaaagaagttgtcatctgacttgatgtataaaaaatgggtcattgattagggatagaaaatgggatgaggaaggaaaaatggggagtgattccttaatggttacagagtgttgggcgataacatcacgtatgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattcagttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttgtgtcaccccaaaacactcccttctgcccctcttcagacagtccttcagctatttcatggctctcaccctagtttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagttttttttttttttgagagacggtctcgctttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgttgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctcttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaa

SEQ ID NO: 322321 - DNA, 3885 bp, Homo sapiens
cgtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagatgctgctcagactctcgctctcgcacaggatcacagtatggatattccaagtcaagaccaactgaagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattcagttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttgtgtcaccccaaaacactcccttctgcccctcttcagacagtccttcagctatttcatggctctcaccctagtttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagttttttttttttttgagagacggtctcgctttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgttgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctcttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatctgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaa

SEQ ID NO: 322322 - DNA, 3124 bp, Homo sapiens
  misc_feature (2881)..(2881): n is a, c, g, or t
cgtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagatgctgctcagactctcgctctcgcacaggatcacagtatggatattccaagtcaagaccaactgaagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattcagttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttgtgtcaccccaaaacactcccttctgcccctcttcagacagtccttcagctatttcatggctctcaccctagtttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagttttttttttttttgagagacggtctcgctttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccacagcgcccagtaaactatttctgggctgttcgattttcttttttccttgccactggcgtacagatttctctgtactcacgtgccactaaaactaaaagcaangggataagtttatattggtgaacgggtccagacgttcacttggtataagggaaacttccaaatctgacattcaccctttaagctggagtatgtgggcccacgtgttccggtttctcggaagacggcaaatggcccatttttggtcccacggtttttctggatggccccttacttcaacgctttctgcgggtggcaatttggcgccacttttgaaacctgcggaagaaatcgtgggaagagatc

SEQ ID NO: 322323 - DNA, 3210 bp, Homo sapiens
gactctagcgatcccttaaatagttgagcattacttctaggtgtaagttgcttctcaagtttcctaaaaaccaccaaggcaggccagctgcatcccactcctcaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattcagttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttgtgtcaccccaaaacactcccttctgcccctcttcagacagtccttcagctatttcatggctctcaccctagtttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagttttttttttttttgagagacggtctcgctttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgttgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctcttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaa

SEQ ID NO: 322324 - DNA, 1188 bp, Homo sapiens
cgtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagaaatgggtcatttgttctgtagaatttcccacgctctagagttggcagattaatgtcgctttagatgaagatgctattgttttatgaagcaaacggggaaaaatccagatttcaagatcccataaccctgtatgacttaacacttgaaagttgaaattaaatgtaaaaagccatacactcttttccttttgtttgtgagttaggcgaatttggtaatatataggaagagatgacaaaaatagactccattatgtcctgcttggaaccagttttcatataaaaatttaaaagcttgatatggaagaacatttttagctatttttcactgttttttttcccgattatattttggtaatatattttggatatggcctgtcttggtctttgtcatttttatcaattttgatttttcccttgcaaatgagagctttgtccagccaacatggagaagtacatttctagggactaaacctggctcccgggttgtttgctgaggtcctttttgtgtggaaagaatggttattaccagggaaggttttccttttgttttacttgctatccagatgctgctcagactctcgctctcgcacaggatcacagtatggatattccaagtcaagaccaactgaaggtaaaatcaccacacggtgacttcttttgttgtacagagtggcccct

SEQ ID NO: 322325 - DNA, 387 bp, Homo sapiens
ggaaagaatatgtcagaactaatggaatgttttgtagcttcttagagtgtcacctgtagaagggaatttagggaatagattctatttacttgagcaactacaagtccttaccttttaaactcttcagtactgtttcttaggtgttatacctgatttagtgttaaaagagaaaagtccatgcctgacaccattatatccatccattagtttatccacagtaggtgtcaagtagatatatgttgaatgaatacatgtccactgaataaaggcaagatgttctttggcgatgtagtgtgacgacattgagttttgggttcatttgtgttgtttcaacatctctgataaacctctgaatacagaaactcatgtttgttttttttctgttag

SEQ ID NO: 322326 - DNA, 275 bp, Homo sapiens
atgtgtcatatgtgtcttttacttctgctggttgcctttgtgtgaatgctaaatagggaattttctgcattagaatagatgttataaatttttttttctatttagttttaccaacagactgcagtttcttcactaccaaaatgacatcattttccacctctgctcagtgttcaacatctgacagtgcttgcaggatctctcctggacaaatcaatcaggtaaatcattttcggtatttctagttttttggttttttttttttttaatttttaaaa

SEQ ID NO: 322327 - DNA, 614 bp, Homo sapiens
atagaatagacttctttatttggacgtctgagaaaatttttaagaggatactaggtaaattcactgctttttctcattgtcagatcagttcatttctgtgctgaaaagtctgggtctgttaattgtcagaaagacaatgagtagatggacctagtagttgggagcggctttcctgttgtaggaccccttacacaaactttgacagtcttgtaaatatgttatttctttctttagcaaactaacttaccttacctcctctaatgaatttgtgtttttggtagcagctggacagatcacaacatggtattttattccatgcaggtcatgcactatttaggtcagtacataatggtgaagcaactttatgatcagcaggagcagcatatggtatattgtggtggagatcttttgggagaactactgggacgtcagagcttctccgtgaaagacccaaggtaaaaacagtgagggcttgcgtatctttttgggtgcttatacctagccacttaatttctatgggttattaatatttattacttcactcaacaaatatgtaagagcctacatatgttaggtagcctatgaggcactgagaatatggtaatgagcgacac

SEQ ID NO: 322328 - DNA, 300 bp, Homo sapiens
agcagttgtcttttttgctttcagttaattagcctcatctaaaacaagtaaacattactaatgagatgtttttgccttcacaggtgattgaagtgggaaaaaatgatgacctggaggactctaagtccttaagtgatgataccgatgtagaggttacctctgaggtatgaatctttagcaagaactattttgcaccagccccatcttcagatgatgtaatcccagcagttcacttgtgttgaagagtgctgtttacccctcatttctgtctcccttgcctagttgctaagtgatgttggt

SEQ ID NO: 322329 - DNA, 509 bp, Homo sapiens
cgtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatcgctttctacactgtattacataaataaattaaataaaataa

SEQ ID NO: 322330 - DNA, 4502 bp, Homo sapiens
cgtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagaaatgggtcatttgttctgtagaatttcccacgctctagagttggcagattaatgtcgctttagatgaagatgctattgttttatgaagcaaacggggaaaaatccagatttcaagatcccataaccctgtatgacttaacacttgaaagttgaaattaaatgtaaaaagccatacactcttttccttttgtttgtgagttaggcgaatttggtaatatataggaagagatgacaaaaatagactccattatgtcctgcttggaaccagttttcatataaaaatttaaaagcttgatatggaagaacatttttagctatttttcactgttttttttcccgattatattttggtaatatattttggatatggcctgtcttggtctttgtcatttttatcaattttgatttttcccttgcaaatgagagctttgtccagccaacatggagaagtacatttctagggactaaacctggctcccgggttgtttgctgaggtcctttttgtgtggaaagaatggttattaccagggaaggttttccttttgttttacttgctatccagatgctgctcagactctcgctctcgcacaggatcacagtatggatattccaagtcaagaccaactgaagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattcagttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttgtgtcaccccaaaacactcccttctgcccctcttcagacagtccttcagctatttcatggctctcaccctagtttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagttttttttttttttgagagacggtctcgctttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgttgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctcttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaa

SEQ ID NO: 322331 - DNA, 3496 bp, Homo sapiens
ggggaaactttatagtcatcttggtacgtggcgagggtttcatatgttttctgaattatgcctaattttgtagtagactggagggtttatacagatagcctgtttttaacagtagattttggcctttgtgcagagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattcagttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttgtgtcaccccaaaacactcccttctgcccctcttcagacagtccttcagctatttcatggctctcaccctagtttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagttttttttttttttgagagacggtctcgctttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgttgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctcttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaa

SEQ ID NO: 322332 - DNA, 1669 bp, Homo sapiens
cgtgtgggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagatgctgctcagactctcgctctcgcacaggatcacagtatggatattccaagtcaagaccaactgaagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttat

SEQ ID NO: 322333 - DNA, 341 bp, Homo sapiens
ataaagtagcctgatgttagcgaaaactctctctgaggtcagatgattgcatttgcaaagtcctatgatgtcacatggaaggcaaatatctgcagtttcttagttctgctctgacatgtgtgtcatcaggaataatctctttgcctctggtgtagttggcaccgacactatccctttctcaaaatctctcccatgttgtttgtgctggaacagcctccccaccccttcattctgtcatccctctcccttgccttaacccacaattcttcatgatgttgatactgtatttgatatccaaaaatgacagcatagtttagctttggggttcaaactgatgtctg

SEQ ID NO: 322334 - DNA, 1417 bp, Homo sapiens
tcatcagtataaacataaatttattaccttggttaaatactacaatgaacagaaaaaacattagcatctgaacgtcttgtaagctagttgtaaggcagaatatgtttgttcactcagaaatcaaattttttaaaaaaaattatttaaatatgcgtaattctcaggcaaaactgataagtgccaaatgagtgatcaataagctccaatccttagctttttgtatactggttgcatttttaatgcaaaaaaatgcacttctgtggctgaaaaaaaaaaaagatggcaaacgaaataaagaaactgaggaagaactatgagtgaaggaataaaatacataaacatgaatatatcttcataggtatatacaccttatcaaacactatatttttgtagcttctaagtcacctttcccaactttttaattcacatatatgattgagaaaggcactttgtgaatatattttctttaaagatataaaataataccttaaaatgatacagcagagtcaatacgttatacggtagattctaatctggtatggttaggagagctgttatttcaccaaatcaggcatggaaaatcagtaaatagacaagaatgtgatactagtatcaaagcgttgtctgtatatgaagccttaaaagcaaaaaaaccccataaccctgaaaaaaacaaaagtattaataagcttgttttaaaacaactgatttcccagacccacctaacatgcaaagacaagaggaacattcctcactcagtcagaatctacactgaaacttatgtgaatgaacttgacccgggctggcagcaatccagcaatcttcgtcactgaatgacttaacagaacactgtgttcttggcaaaagcacaaaaaatgtgttgaaatccacactaaaaaaaaaaaaaaaatctcagtatagatttaaatcaattttaaaatacaatgataaaagatactaaaatataataagggattttcagtgtttggtacatatttaattcaggtaacatttttaccctcatgccattttggtcactttcaatcttcccttgaacaattgctccaaccctctccccaccacactaaacctacgctctggcctcctcctgtgttacaacttctccaacactgtacctggaaaattccaaagcaacctaagcttgcatattagggagggacagcaagaaaagccagaaacaatgtgttgactcacttccgtggaaagccctagagaaaaatctaggccacagttcagcactctcacgcgttgcagctggagcaggtaagaggcggtgaagttatgtcattctcacacaggtcctgctaattcggccacaagggtaagatgcaaatgagaaggtaagtaaaatacaatctggcgtatatataagtatgcaggcagtctacacactttc

SEQ ID NO: 322335 - DNA, 336 bp, Homo sapiens
tttgaaaagggcagagtcaaacacaattttatgttgttacgggatgttaaaaactgcacccagggctggacacggtggctcactcctgtaatcccagcacctggggaggctgacgcaggcagatcacaaggtcaggagttcaagaccagcctggccaacatagtgaaaccctgtctctactaaaaatacaaaaattagctgggcatggtggtgcatgcctgtagtctcagctacttgagaggctgaggcaagagaatcgcttgaacccaggagttggaggttgcagtgagccaagattgtgccactgggctccagcttgggcaacagagtgacact

SEQ ID NO: 322336 - DNA, 1059 bp, Homo sapiens
atgtcagccccactggatgccgccctccacgcccttcaggaggagcaggccagaccgccctccacgcccttcaggaggagcaggccagactcaagatgaggctgtgggacctgcagcagctgagaaaggagctcggggactcccccaaagacaaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaagtggctgagcaggtgctgcaacaaaaggagcacacgatcaacatggaggagtgccggctgcgggtgcaggtccagcccttggagctgcccatggtcaccaccatccaggtgatggtgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggagtggctcagcgtctgtgccaaatcggccagttcacagtgccactgggtgggcagcaagtccctctgagagtctctccgtatgtgaatggggagatccagaaggctgagatcaggtcgcagccagttccccgctcggtactggtgctcaacattcctgatatcttggatggcccggagctgcatgacgtcctggagatccacttccagaagcccacccgcgggggcggggaggtagaggccctgacagtcgtaccccaaggacagcagggcctagcagtcttcacctctgagtcaggctaggggcctccccttctcatcctccccacccccccgccaaggttctcacactggcctgggcttgggtgcccatataggaggtctgtatgttcaccaacagtgcggaggggtcacacattgcaaaacactgcccagaacagtaaaaagagcctgcatgcca

SEQ ID NO: 322337 - DNA, 198 bp, Homo sapiens
gtatagaggagaataaggagacacacaaataatgtggtgtgagcagaagaagttatatcctccccacccccccgccaaggttctcacactggcctgggcttgggtgcccatataggaggtctgtatgttcaccaacagtgcggaggggtcacacattgcaaaacactgcccagaacagtaaaaagagcctgcatgcca

SEQ ID NO: 322338 - DNA, 1214 bp, Homo sapiens
aaactaggctaggtacgagcctgggtggtgagaaagctgcgagcagagctcctgaggtgtatttcgggtcttgctggggctgagagagacacagccctttggggggtacaaacaagagttcagttgctgtgaattctgccactgtgcccagctctgaagcctcagctcttgccaaacagacccgagacccatgtcagccccactggatgccgccctccacgcccttcaggaggagcaggccagactcaagatgaggctgtgggacctgcagcagctgagaaaggagctcggggactcccccaaagacaaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaagtggctgagcaggtgctgcaacaaaaggagcacacgatcaacatggaggagtgccggctgcgggtgcaggtccagcccttggagctgcccatggtcaccaccatccaggtgatggtgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggagtggctcagcgtctgtgccaaatcggccagttcacagtgccactgggtgggcagcaagtccctctgagagtctctccgtatgtgaatggggagatccagaaggctgagatcaggtcgcagccagttccccgctcggtactggtgctcaacattcctgatatcttggatggcccggagctgcatgacgtcctggagatccacttccagaagcccacccgcgggggcggggaggtagaggccctgacagtcgtaccccaaggacagcagggcctagcagtcttcacctctgagtcaggctaggggcctccccttctcatcctccccacccccccgccaaggttctcacactggcctgggcttgggtgcccatataggaggtctgtatgttcaccaacagtgcggaggggtcacacattgcaaaacactgcccagaacagtaaaaagagcctgcatgcca

SEQ ID NO: 322339 - DNA, 1120 bp, Homo sapiens
cttgagcttagcatcaactctgcttttggagcgtccagaataggccccccttcccctgggcttgttgattctctggaagggcgggtagaagtcttgttgtttccttctgccccaaccgccctccacgcccttcaggaggagcaggccagactcaagatgaggctgtgggacctgcagcagctgagaaaggagctcggggactcccccaaagacaaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaagtggctgagcaggtgctgcaacaaaaggagcacacgatcaacatggaggagtgccggctgcgggtgcaggtccagcccttggagctgcccatggtcaccaccatccaggtgatggtgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggagtggctcagcgtctgtgccaaatcggccagttcacagtgccactgggtgggcagcaagtccctctgagagtctctccgtatgtgaatggggagatccagaaggctgagatcaggtcgcagccagttccccgctcggtactggtgctcaacattcctgatatcttggatggcccggagctgcatgacgtcctggagatccacttccagaagcccacccgcgggggcggggaggtagaggccctgacagtcgtaccccaaggacagcagggcctagcagtcttcacctctgagtcaggctaggggcctccccttctcatcctccccacccccccgccaaggttctcacactggcctgggcttgggtgcccatataggaggtctgtatgttcaccaacagtgcggaggggtcacacattgcaaaacactgcccagaacagtaaaaagagcctgcatgcca

SEQ ID NO: 322340 - DNA, 1287 bp, Homo sapiens
cggacgcgtgggtcgacccacgcgtccgggcatgtgagcgccagaaggcagggatttcacggaaatgaaagtggaagcaaacagcctgcgagcagagcctcctgaggtgtatttcgggtcttgctggggctgagagagaccacagccctttggggggtacaaacaagagttcagttgctgtgaattctgccactgtgcccagctctgaagcctcagctcttgccaaacagacccgagacccatgtcagccccactggatgccgccctccacgcccttcaggaggagcaggccagactcaagatgaggctgtgggacctgcagcagctgagaaaggagctcggggactcccccaaagacaaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaagtggctgagcaggtgctgcaacaaaaggagcacacgatcaacatggaggagtgccggctgcgggtgcaggtccagcccttggagctgcccatggtcaccaccatccaggtgatggtgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggagtggctcagcgtctgtgccaaatcggccagttcacagtgccactgggtgggcagcaagtccctctgagagtctctccgtatgtgaatggggagatccagaaggctgagatcaggtcgcagccagttccccgctcggtactggtgctcaacattcctgatatcttggatggcccggagctgcatgacgtcctggagatccacttccagaagcccacccgcgggggcggggaggtagaggccctgacagtcgtaccccaaggacagcagggcctagcagtcttcacctctgagtcaggctaggggcctccccttctcatcctccccacccccccgccaaggttctcacactggcctgggcttgggtgcccatataggaggtctgtatgttcaccaacagtgcggaggggtcacacattgcaaaacactgcccagaacagtaaaaagagcctgcatgccaaaaaaaaaaaagaaaagttttg

SEQ ID NO: 322341 - DNA, 1154 bp, Homo sapiens
cggacgcgtgggtcgacccacgcgtccgggcatgtgagcgccagaaggcagggatttcacggaaatgaaagtggaagcaaacagcctgcgagcagagcctcctgaggtgtatttcgggtcttgctggggctgagagagaccacagccctttggggggtacaaacaagagttcagttgctgtgaattctgccactgtgcccagctctgaagcctcagctcttgccaaacagacccgagacccatgtcagccccactggatgccgccctccacgcccttcaggaggagcaggccagactcaagatgaggctgtgggacctgcagcagctgagaaaggagctcggggactcccccaaagacaaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaagtggctgagcaggtgctgcaacaaaaggagcacacgatcaacatggaggagtgccggctgcgggtgcaggtccagcccttggagctgcccatggtcaccaccatccaggtgatggtgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggagtggctcagcgtctgtgccaaatcggccagttcacagtgccactgggtgggcagcaagtccctctgagagtctctccgtatgtgaatggggagatccagaaggctgagatcaggtcgcagccagttccccgctcggtactggtgctcaacattcctgatatcttggatggcccggagctgcatgacgtcctggagatccacttccagaagcccacccccccgccaaggttctcacactggcctgggcttgggtgcccatataggaggtctgtatgttcaccaacagtgcggaggggtcacacattgcaaaacactgcccagaacagtaaaaagagcctgcatgcca

SEQ ID NO: 322342 - DNA, 1265 bp, Homo sapiens
cggacgcgtgggtcgacccacgcgtccgggcatgtgagcgccagaaggcagggatttcacggaaatgaaagtggaagcaaacagcctgcgagcagagcctcctgaggtgtatttcgggtcttgctggggctgagagagaccacagccctttggggggtacaaacaagagttcagttgctgtgaattctgccactgtgcccagctctgaagcctcagctcttgccaaacagacccgagacccatgtcagccccactggatgccgccctccacgcccttcaggaggagcaggccagactcaagatgaggctgtgggacctgcagcagctgagaaaggagctcggggactcccccaaagacaaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaagtggctgagcaggtgctgcaacaaaaggagcacacgatcaacatggaggagtgccggctgcgggtgcaggtccagcccttggagctgcccatggtcaccaccatccaggtgatggtgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggagtggctcagcgtctgtgccaaatcggccagttcacagtgccactgggtgggcagcaagtccctctgagagtctctccgtatgtgaatggggagatccagaaggctgagatcaggtcgcagccagttccccgctcggtactggtgctcaacattcctgatatcttggatggcccggagctgcatgacgtcctggagatccacttccagaagcccacccgcgggggcggggaggtagaggccctgacagtcgtaccccaaggacagcagggcctagcagtcttcacctctgagtcaggctaggggcctccccttctcatcctccccacccccccgccaaggttctcacactggcctgggcttgggtgcccatataggaggtctgtatgttcaccaacagtgcggaggggtcacacattgcaaaacactgcccagaacagtaaaaagagcctgcatgcca

SEQ ID NO: 322343 - DNA, 1358 bp, Homo sapiens
cggacgcgtgggtcgacccacgcgtccgggcatgtgagcgccagaaggcagggatttcacggaaatgaaagtggaagcaaacagcctgcgagcagagcctcctgaggtgtatttcgggtcttgctggggctgagagagaccacagccctttggggggtacaaacaagagttcagttgctgtgaattctgccactgtgcccagctctgaagcctcagctcttgccaaacagacccgagacccatgtcagccccactggatgccgccctccacgcccttcaggaggagcaggccagactcaagatgaggctgtgggacctgcagcagctgagaaaggagctcggggactcccccaaagacaaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaagtggctgagcaggtgctgcaacaaaaggagcacacgatcaacatggaggagtgccggctgcgggtgcaggtccagcccttggagctgcccatggtcaccaccatccaggtgatggtgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggagtggctcagcgtctgtgccaaatcggccagttcacagtgccactgggtgggcagcaagtccctctgagagtctctccgtatgtgaatggggagatccagaaggctgagatcaggtcgcagccagttccccgctcggtactggtgctcaacattcctgatatcttggatggcccggagctgcatgacgtcctggagatccacttccagaagcccacccgcgggggcggggaggtagaggccctgacagtcgtaccccaaggacagcagggcctagcagtcttcacctctgagtcaggctaggggcctccccttctcatcctccccacccccccgccaaggttctcacactggcctgggcttgggtgcccatataggaggtctgtatgttcaccaacagtgcggaggggtcacacattgcaaaacactgcccagaacagtaaaaagagcctgcatgccaaacaatcataacatcaaaaaagggggcgcctaaaattcccgggggccaattttcgtatcccgttttttccagggccataggaggctttaacca

SEQ ID NO: 322344 - DNA, 957 bp, Homo sapiens
cttcctcctaggtgggagtgaggaacactcctactcccctcccctacttccaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaagtggctgagcaggtgctgcaacaaaaggagcacacgatcaacatggaggagtgccggctgcgggtgcaggtccagcccttggagctgcccatggtcaccaccatccaggtgatggtgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggagtggctcagcgtctgtgccaaatcggccagttcacagtgccactgggtgggcagcaagtccctctgagagtctctccgtatgtgaatggggagatccagaaggctgagatcaggtcgcagccagttccccgctcggtactggtgctcaacattcctgatatcttggatggcccggagctgcatgacgtcctggagatccacttccagaagcccacccgcgggggcggggaggtagaggccctgacagtcgtaccccaaggacagcagggcctagcagtcttcacctctgagtcaggctaggggcctccccttctcatcctccccacccccccgccaaggttctcacactggcctgggcttgggtgcccatataggaggtctgtatgttcaccaacagtgcggaggggtcacacattgcaaaacactgcccagaacagtaaaaagagcctgcatgcca

SEQ ID NO: 322345 - DNA, 1130 bp, Homo sapiens
tgcagggcggggtgggcgggggtagcaggaagaatgtctcagggctatgtgagactggcaggagaagataagactttatgcctgagctcagtcgtttagttcctggtgtatgtgcttttgaatgtttatgttcataaagtcaccattttctgtttcctcttcgggaatgtttttactaacatgagtggctattcagagtattgcaatagatgagctgcttttaaatttgctttaagtcaggtgttcaaggttttctttggacagctcccaaggtagaaatggaagactctagacactatatgaagaaaaagatcaggaaagctctcctcttctttggtcttaggggatgttttgtttttagtgtttccatcctggtgaatgtctccatagccttcacttcttatgtttgttatacagagactcatgtttttctagatgcagagtttttatccacaaggaaacagttcttaacaccacacagtaaccactctcaatatttcttgcataagttcatgggatcagagactagagctaagtcaggctgttttgctacatgggattgttttggtcaccaagtgtacaagcagtggtggtctgtggtcgcctgcacataggccaggaggacagtgtgtgtcatgactgaaactctcctttgtctctgtgtgtggcaggtctggcagacccgtctgcgttaacacaagcggttgctgcctaccaaggctgtcattttataggcatgcctgaatgtgaggtaaagtaatcagctcatttcttgcaaatcacttcttttctctctcgtgctctgtccctttgtagatttgaataaatgtccctccttcaccattggtgtattggacccactgagtatgctgcttggctttggaattccaattgtagactcttagactcctagagagggaaaccttctgtgtcaacgaggtcatgtttcaaactgttctcgggattccggggttcagagcacatgctccatatgttccagggagcagaaaggttaaaggagctgaacagcaaagcctctgcaagttcgcccccagagcagcttcatattcatctcttttatatattgggggcttaagaaaaatttaatgtagtaaaaagtccttcagtaa

SEQ ID NO: 322346 - DNA, 1504 bp, Homo sapiens
gtttagtcttgggagggtgtatatgtccaggaatttatccatttcttctagattttctagcttatttttgtagcagtgtttgtagtattctctgctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagtactcttcgattctgtcatggttttcctgcctggatgctaggtaccagcgttgtcaccattgcatttggtgggtggatactgggaaggagaaatcaccccagatgggaagagtggggagcttaagttaagaagtcagtgttatcttgttgaaagttaactctgatctctttaaaggaatacataaaggaattctttaaatggcttgtggaagactccagtagtcccatgcccattttttcccacttgtcctggtttcttcttgcagctccatatttctaaacagtcgtttttcttttactttatgtgtgtcctgaacacaaaatacgccactccttctgctcagttaagagttatttgtccctactgctacttcctctccctctccttagttgcatgtcgtgcatatgcccacaaggatggccccttcaggtagtcggttctcctcctgccgttgcgtgatccctcctggggtcctcctgccatgtctggaaggctgccggctgttggcctgggacgtcctctgcctttattctgagtgagatgcccattttctggatgctccatcccgccttactggtttattccgctatttcagtgcaacccatcctctagtagttttatcaggctggagggactgtatgttgcagaggcttggcccgactggcctccctccttctgtctggagtggttgcactgcagtgtgcagttgccatccccagaatctcccttcatcatcaccctggagctttcctctgcttctccctgcaccccatctgatgacaggactgactgctttctggcacaggtggcatgtaccctctagtagctttatggagcaggggtgtgtggaggaaaagtatttttagacctcaggagactcaaaatgcttttattgtaccttcagacgtgtctgagggtttggctagtaataaattgtaggtaagaaattgtgcattgttttacactttcccacattgttgtcaagtttgaaggcatcctgatgtgtgtggtcttttgtttgtaacctctatcaacttgtagactcttctgtctttgctccccgtgttttaaaagtctgcactgggtacttgttgggcctttcaatctggaaactcctttcagttctagggaagtttctttttttattcaataaatttatttatttatgaaaaaa

SEQ ID NO: 322347 - DNA, 4129 bp, Homo sapiens
cacttcactttctccacctcttccctgcactgaaaaaaggccattttctccagctggttgctgttataacacgtgttgaattcttccagcctcttcacttttaacatcttagtagtgagtccgattaagctactttctggagtgtggttttcgtctccctctgtctccgatttataaatcaggacacaattatgactcttcagtgcttctttctcttgaatgccgcgcgaggcgcctccgccgccggggcaaacggccacgaactacacttcccgacacgccgcgtgaggcgctgccagcggccggccgagggcgggcggacgcgggagctgcggacgtgaggcatgagcggcgccctcctccggcccgcgagcgtcctgctggttccccgagcgagggtctcgcggcgcggggcctagcggagggcatcgaaggcctccgcgtgcgcacgggttgctgcggccgcgccgggcgccggggagggcggcggccgccatggaggtgagcgggccggaagacgaccccttcctttcgcagctgcaccaggtgcagtgccccgtgtgccagcagatgatgcccgccgcgcacatcaactcgcacctggaccgctgtctgctgctccacccggcggggcacgcggagcccgcggccgggtcgcaccgcgccggggagcgggccaaggggccctcgccgcccggcgccaagaggcggcggctgtcggagagctcggcgctgaagcagccagccaccccgacggcagccgagagcagcgagggcgagggtgaggagggcgacgacggcggcgagaccgagagccgcgagagctacgacgcgccgcccacacccagcggcgcccgccttatccccgacttcccggtggcccgctccagcagccccgggaggaaggggtcggggaagaggccggcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggacactttccttcctcacgtggaatgtgggacgatcactctgattggggcaaccactgaaaacccttccttccaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagtactcttcgattctgtcatggttttcctgcctggatgctaggtaccagcgttgtcaccattgcatttggtgggtggatactgggaaggagaaatcaccccagatgggaagagtggggagcttaagttaagaagtcagtgttatcttgttgaaagttaactctgatctctttaaaggaatacataaaggaattctttaaatggcttgtggaagactccagtagtcccatgcccattttttcccacttgtcctggtttcttcttgcagctccatatttctaaacagtcgtttttcttttactttatgtgtgtcctgaacacaaaatacgccactccttctgctcagttaagagttatttgtccctactgctacttcctctccctctccttagttgcatgtcgtgcatatgcccacaaggatggccccttcaggtagtcggttctcctcctgccgttgcgtgatccctcctggggtcctcctgccatgtctggaaggctgccggctgttggcctgggacgtcctctgcctttattctgagtgagatgcccattttctggatgctccatcccgccttactggtttattccgctatttcagtgcaacccatcctctagtagttttatcaggctggagggactgtatgttgcagaggcttggcccgactggcctccctccttctgtctggagtggttgcactgcagtgtgcagttgccatccccagaatctcccttcatcatcaccctggagctttcctctgcttctccctgcaccccatctgatgacaggactgactgctttctggcacaggtggcatgtaccctctagtagctttatggagcaggggtgtgtggaggaaaagtatttttagacctcaggagactcaaaatgcttttattgtaccttcagacgtgtctgagggtttggctagtaataaattgtaggtaagaaattgtgcattgttttacactttcccacattgttgtcaagtttgaaggcatcctgatgtgtgtggtcttttgtttgtaacctctatcaacttgtagactcttctgtctttgctccccgtgttttaaaagtctgcactgggtacttgttgggcctttcaatctggaaactcctttcagttctagggaagtttctttttttattcaataaatttatttatttatgaaaaaa

SEQ ID NO: 322348 - DNA, 2881 bp, Homo sapiens
cacttcactttctccacctcttccctgcactgaaaaaaggccattttctccagctggttgctgttataacacgtgttgaattcttccagcctcttcacttttaacatcttagtagtgagtccgattaagctactttctggagtgtggttttcgtctccctctgtctccgatttataaatcaggacacaattatgactcttcagtgcttctttctcttgaatgccgcgcgaggcgcctccgccgccggggcaaacggccacgaactacacttcccgacacgccgcgtgaggcgctgccagcggccggccgagggcgggcggacgcgggagctgcggacgtgaggcatgagcggcgccctcctccggcccgcgagcgtcctgctggttccccgagcgagggtctcgcggcgcggggcctagcggagggcatcgaaggcctccgcgtgcgcacgggttgctgcggccgcgccgggcgccggggagggcggcggccgccatggaggtgagcgggccggaagacgaccccttcctttcgcagctgcaccaggtgcagtgccccgtgtgccagcagatgatgcccgccgcgcacatcaactcgcacctggaccgctgtctgctgctccacccggcggggcacgcggagcccgcggccgggtcgcaccgcgccggggagcgggccaaggggccctcgccgcccggcgccaagaggcggcggctgtcggagagctcggcgctgaagcagccagccaccccgacggcagccgagagcagcgagggcgagggtgaggagggcgacgacggcggcgagaccgagagccgcgagagctacgacgcgccgcccacacccagcggcgcccgccttatccccgacttcccggtggcccgctccagcagccccgggaggaaggggtcggggaagaggccggcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagta

SEQ ID NO: 322349 - DNA, 2596 bp, Homo sapiens
cacttcactttctccacctcttccctgcactgaaaaaaggccattttctccagctggttgctgttataacacgtgttgaattcttccagcctcttcacttttaacatcttagtagtgagtccgattaagctactttctggagtgtggttttcgtctccctctgtctccgatttataaatcaggacacaattatgactcttcagtgcttctttctcttgaatgccgcgcgaggcgcctccgccgccggggcaaacggccacgaactacacttcccgacacgccgcgtgaggcgctgccagcggccggccgagggcgggcggacgcgggagctgcggacgtgaggcatgagcggcgccctcctccggcccgcgagcgtcctgctggttccccgagcgagggtctcgcggcgcggggcctagcggagggcatcgaaggcctccgcgtgcgcacgggttgctgcggccgcgccgggcgccggggagggcggcggccgccatggaggtgagcgggccggaagacgaccccttcctttcgcagctgcaccaggtgcagtgccccgtgtgccagcagatgatgcccgccgcgcacatcaactcgcacctggaccgctgtctgctgctccacccggcggggcacgcggagcccgcggccgggtcgcaccgcgccggggagcgggccaaggggccctcgccgcccggcgccaagaggcggcggctgtcggagagctcggcgctgaagcagccagccaccccgacggcagccgagagcagcgagggcgagggtgaggagggcgacgacggcggcgagaccgagagccgcgagagctacgacgcgccgcccacacccagcggcgcccgccttatccccgacttcccggtggcccgctccagcagccccgggaggaaggggtcggggaagaggccggcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggacactttccttcctcacgtggaatgtgggacgatcactctgattggggcaaccactgaaaacccttccttccaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtaaagtaatcagctcatttcttgcaaatcacttcttttctctctcgtgctctgtccctttgtagatttgaataaatgtccctccttcaccattggtgtattggacccactgagtatgctgcttggctttggaattccaattgtagactcttagactcctagagagggaaaccttctgtgtcaacgaggtcatgtttcaaactgttctcgggattccggggttcagagcacatgctccatatgttccagggagcagaaaggttaaaggagctgaacagcaaagcctctgcaagttcgcccccagagcagcttcatattcatctcttttatatattgggggcttaagaaaaatttaatgtagtaaaaagtccttcagtaa

SEQ ID NO: 322350 - DNA, 2169 bp, Homo sapiens
cacttcactttctccacctcttccctgcactgaaaaaaggccattttctccagctggttgctgttataacacgtgttgaattcttccagcctcttcacttttaacatcttagtagtgagtccgattaagctactttctggagtgtggttttcgtctccctctgtctccgatttataaatcaggacacaattatgactcttcagtgcttctttctcttgaatgccgcgcgaggcgcctccgccgccggggcaaacggccacgaactacacttcccgacacgccgcgtgaggcgctgccagcggccggccgagggcgggcggacgcgggagctgcggacgtgaggcatgagcggcgccctcctccggcccgcgagcgtcctgctggttccccgagcgagggtctcgcggcgcggggcctagcggagggcatcgaaggcctccgcgtgcgcacgggttgctgcggccgcgccgggcgccggggagggcggcggccgccatggaggtgagcgggccggaagacgaccccttcctttcgcagctgcaccaggtgcagtgccccgtgtgccagcagatgatgcccgccgcgcacatcaactcgcacctggaccgctgtctgctgctccacccggcggggcacgcggagcccgcggccgggtcgcaccgcgccggggagcgggccaaggggccctcgccgcccggcgccaagaggcggcggctgtcggagagctcggcgctgaagcagccagccaccccgacggcagccgagagcagcgagggcgagggtgaggagggcgacgacggcggcgagaccgagagccgcgagagctacgacgcgccgcccacacccagcggcgcccgccttatccccgacttcccggtggcccgctccagcagccccgggaggaaggggtcggggaagaggccggcggccgccgccgcggcggggagcgcgtctccgcgcagctgggacgaggcggaggcgcaggaggaggaggaggccgtgggcgacggcgatggcgacggggacgcggacctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagta

SEQ ID NO: 322351 - DNA, 1490 bp, Homo sapiens
tgcagggcggggtgggcgggggtagcaggaagaatgtctcagggctatgtgagactggcaggagaagataagactttatgcctgagctcagtcgtttagttcctggtgtatgtgcttttgaatgtttatgttcataaagtcaccattttctgtttcctcttcgggaatgtttttactaacatgagtggctattcagagtattgcaatagatgagctgcttttaaatttgctttaagtcaggtgttcaaggttttctttggacagctcccaaggtagaaatggaagactctagacactatatgaagaaaaagatcaggaaagctctcctcttctttggtcttaggggatgttttgtttttagtgtttccatcctggtgaatgtctccatagccttcacttcttatgtttgttatacagagactcatgtttttctagatgcagagtttttatccacaaggaaacagttcttaacaccacacagtaaccactctcaatatttcttgcataagttcatgggatcagagactagagctaagtcaggctgttttgctacatgggattgttttggtcaccaagtgtacaagcagtggtggtctgtggtcgcctgcacataggccaggaggacagtgtgtgtcatgactgaaactctcctttgtctctgtgtgtggcaggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagta

SEQ ID NO: 322352 - DNA, 2956 bp, Homo sapiens
cacttcactttctccacctcttccctgcactgaaaaaaggccattttctccagctggttgctgttataacacgtgttgaattcttccagcctcttcacttttaacatcttagtagtgagtccgattaagctactttctggagtgtggttttcgtctccctctgtctccgatttataaatcaggacacaattatgactcttcagtgcttctttctcttgaatgccgcgcgaggcgcctccgccgccggggcaaacggccacgaactacacttcccgacacgccgcgtgaggcgctgccagcggccggccgagggcgggcggacgcgggagctgcggacgtgaggcatgagcggcgccctcctccggcccgcgagcgtcctgctggttccccgagcgagggtctcgcggcgcggggcctagcggagggcatcgaaggcctccgcgtgcgcacgggttgctgcggccgcgccgggcgccggggagggcggcggccgccatggaggtgagcgggccggaagacgaccccttcctttcgcagctgcaccaggtgcagtgccccgtgtgccagcagatgatgcccgccgcgcacatcaactcgcacctggaccgctgtctgctgctccacccggcggggcacgcggagcccgcggccgggtcgcaccgcgccggggagcgggccaaggggccctcgccgcccggcgccaagaggcggcggctgtcggagagctcggcgctgaagcagccagccaccccgacggcagccgagagcagcgagggcgagggtgaggagggcgacgacggcggcgagaccgagagccgcgagagctacgacgcgccgcccacacccagcggcgcccgccttatccccgacttcccggtggcccgctccagcagccccgggaggaaggggtcggggaagaggccggcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggacactttccttcctcacgtggaatgtgggacgatcactctgattggggcaaccactgaaaacccttccttccaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagta

SEQ ID NO: 322353 - DNA, 2386 bp, Homo sapiens
cacttcactttctccacctcttccctgcactgaaaaaaggccattttctccagctggttgctgttataacacgtgttgaattcttccagcctcttcacttttaacatcttagtagtgagtccgattaagctactttctggagtgtggttttcgtctccctctgtctccgatttataaatcaggacacaattatgactcttcagtgcttctttctcttgaatgccgcgcgaggcgcctccgccgccggggcaaacggccacgaactacacttcccgacacgccgcgtgaggcgctgccagcggccggccgagggcgggcggacgcgggagctgcggacgtgaggcatgagcggcgccctcctccggcccgcgagcgtcctgctggttccccgagcgagggtctcgcggcgcggggcctagcggagggcatcgaaggcctccgcgtgcgcacgggttgctgcggccgcgccgggcgccggggagggcggcggccgccatggaggtgagcgggccggaagacgaccccttcctttcgcagctgcaccaggtgcagtgccccgtgtgccagcagatgatgcccgccgcgcacatcaactcgcacctggaccgctgtctgctgctccacccggcggggcacgcggagcccgcggccgggtcgcaccgcgccggggagcgggccaaggggccctcgccgcccggcgccaagaggcggcggctgtcggagagctcggcgctgaagcagccagccaccccgacggcagccgagagcagcgagggcgagggtgaggagggcgacgacggcggcgagaccgagagccgcgagagctacgacgcgccgcccacacccagcggcgcccgccttatccccgacttcccggtggcccgctccagcagccccgggaggaaggggtcggggaagaggccggcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggacactttccttcctcacgtggaatgtgggacgatcactctgattggggcaaccactgaaaacccttccttccaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtaagtaattcacctgtggaaagagtgaaaccatacggaaagaagtgtgtgcacacattctcatttccggaagcctgactgggttccggaagcattccagctgggtccagagcattccagtgattctcaggtggatctgcatgttggtattaagctttctacacagggctgacctttccgaagagaggcatgaagcagaagctgccctgttgagaatctagaggagttttggggttggaaatggcaggctgcacattcaccttagaaggtagttggctattccccaccttgcagaatacaatcacctttgaaagcctgtgcattcacttgacaatgaatatgttttgtgatcatttacaacggcagtaaataaaaagaggacttttgtcataatgacttattagt

SEQ ID NO: 322354 - DNA, 2522 bp, Homo sapiens
cacttcactttctccacctcttccctgcactgaaaaaaggccattttctccagctggttgctgttataacacgtgttgaattcttccagcctcttcacttttaacatcttagtagtgagtccgattaagctactttctggagtgtggttttcgtctccctctgtctccgatttataaatcaggacacaattatgactcttcagtgcttctttctcttgaatgccgcgcgaggcgcctccgccgccggggcaaacggccacgaactacacttcccgacacgccgcgtgaggcgctgccagcggccggccgagggcgggcggacgcgggagctgcggacgtgaggcatgagcggcgccctcctccggcccgcgagcgtcctgctggttccccgagcgagggtctcgcggcgcggggcctagcggagggcatcgaaggcctccgcgtgcgcacgggttgctgcggccgcgccgggcgccggggagggcggcggccgccatggaggtgagcgggccggaagacgaccccttcctttcgcagctgcaccaggtgcagtgccccgtgtgccagcagatgatgcccgccgcgcacatcaactcgcacctggaccgctgtctgctgctccacccggcggggcacgcggagcccgcggccgggtcgcaccgcgccggggagcgggccaaggggccctcgccgcccggcgccaagaggcggcggctgtcggagagctcggcgctgaagcagccagccaccccgacggcagccgagagcagcgagggcgagggtgaggagggcgacgacggcggcgagaccgagagccgcgagagctacgacgcgccgcccacacccagcggcgcccgccttatccccgacttcccggtggcccgctccagcagccccgggaggaaggggtcggggaagaggccggcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaaggcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagta

SEQ ID NO: 322355 - DNA, 447 bp, Homo sapiens
cggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaaggtgagtgcggccttggccgttgggcttccgtagttatctcggcggtggatgcagctgatggtcggagagc

SEQ ID NO: 322356 - DNA, 532 bp, Homo sapiens
agcttacagtggcgtgaagcatagtggcgtgaaagcaaggatacagaggcagcacaaaggcaattaattcatcaaattgtgacaggtgcataattcaggattacatactgtgtcggaattgatgggttcttggtctcactgacttcaagaaagaagccacggaccctcatgaggtcattttcttctgaggaagtcattcttaaggactgttctgtccccaaccccagctggaacaaggacctaagactgctctttgaccagtttatgaagaaatgtgaagatggctcctggaaacgtttgccttcatataaacgtacacctactgaatggattcaagacttcaaaacccattttcttggtagaaacagccactttcccattaatatatctgagcatcaaatataaagctaagaacagattgaagtactagttactacctgaaaaaaagaaagaatataatgcaggattatggttctatagtcaccaattttatagaccagaaatcacaataaattttgcagattggagagca

SEQ ID NO: 322357 - DNA, 979 bp, Homo sapiens
tgggcggacgcggtgggcggacgcgtgggttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaaatactctgctccctcactgctgaatccctgtagggagaagcctgccaacagtgaccttccgaaacagccttctgaatacaaagaggattcagtttccatcttctcaactttttaacacagaaacacttcctgcgagcatatcgacaactctcgggccaggcgctgtggctcacacagtgctgggattacaggcgtgagcccaccttggcccagccccacatcatacagtttgaacatgaaaactttgccacaacagcctttgctgtagcacacaacatatatcactggaacctgtttgaacttaacgttttcttctttttcatgattcgggctttgagtactccaggctgaaagactgttgtaccagtaaaaacttaaagggccaattctcttggaagacttctcccttttatgtggccccctatttatgttgccttaatcttcgaaattctggctgaacggcatgactgggctccgatgaacatgtccttagcggaatattatgttccatggacaatttttttctccctggccgtccgggcggaacacggaacgcagtcaagtagattccccctcgggagacgagaagattcgcgggaaggcgcgaaacggtgcccgggacatgtgacccatttcgtgcgcaggactcggcgccaacgtgcacgattagggaaaataccatgttgaccacactatcaacaaagcggccctgcgcacgctgagctatacggcgaggaagtatta

SEQ ID NO: 322358 - DNA, 438 bp, Homo sapiens
cttagaaattgggagaatatgttatgaaatagaatgcacctcccattacttacttttctttttcttctgtcttttagaggtcattttcttctgaggaagtcattcttaaggactgttctgtccccaaccccagctggaacaaggacctaagactgctctttgaccagtttatgaagaaatgtgaagatggctcctggaaacgtttgccttcatataaacgtacacctactgaatggattcaagacttcaaaacccattttcttggtagaaacagccactttcccattaatatatctgagcatcaaatataaagctaagaacagattgaagtactagttactacctgaaaaaaagaaagaatataatgcaggattatggttctatagtcaccaattttatagaccagaaatcacaataaattttgcagattggagagca

SEQ ID NO: 322359 - DNA, 505 bp, Homo sapiens
agcttacagtggcgtgaagcatagtggcgtgaaagcaaggatacagaggcagcacaaaggcaattaattcatcaaattgtgacaggtgcataattcaggattacatactgtgtcggaattgatgggttcttggtctcactgacttcaagaaagaagccacggaccctcatggtgagtgttatagttcttaaaggcggcatgtccggcgtttgttccttctgatgttcggatgtgttcagagtttcttccttctggtgggttcatggtcttgctggctcaagagtgaaattgcggaccttcgtggtgagtgttatagctcttaaggcagcacgtctggagttgttcgttcctcccggtgggtttgtggtctcgttggcttcaggagtgaagctgcagaccttcgcggtgagtgttacagctcataaaggcagtgtggacccaaagagtgagcagcagcaagatttattgcaaagagcgaaagaacaaagcttccacagtgtggaag

SEQ ID NO: 322360 - DNA, 2385 bp, Homo sapiens
gcgcgggttccggggctgaggggctgaggggcccaaggcgataaccgggatccgctccggccgcgctcctcttgcctttgagaagccccggaagtggcccggctgttggccgcagcgggaggtcttcggaaagaaaaggccggaaccagaagatagactcaacagcgatgccctacccggaccccgccggcctcacaccccggccagccagccgccagtagtgcgcaccgcctcctccccaagccccgccctgcgtccaccccaggggttaactcgcacgcgcgctcttgtggcggaggtagagtgcgccgtccagggctagagcaagcgcggccccgcggcccggagccatgctgaggagctgcgccgcgcgcctccgcacgctgggggctctgtgccggccgccagtaggccggcgcctgccgggaagcgagccgcgacccgagctgaggtcattttcttctgaggaagtcattcttaaggactgttctgtccccaaccccagctggaacaaggacctaagactgctctttgaccagtttatgaagaaatgtgaagatggctcctggaaacgtttgccttcatataaacgtacacctactgaatggattcaagacttcaaaacccattttcttgacccaaagcttatgaaagaagaacaaatgtcacaggcccagctcttcaccagaagctttgatgatggcctgggctttgaatacgtgatgttctacaatgacattgagaaaaggatggtttgcttatttcaaggaggcccttacctggaaggaccacctggattcattcatggaggtgccattgcaaccatgattgatgctactgttggtatgtgtgcaatgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaaatactctgctccctcactgctgaatccctgtagggagaagcctgccaacagtgaccttccgaaacagccttctgaatacaaagaggattcagtttccatcttctcaactttttaacacagaaacacttcctgcgagcatatcgacaactctcgggccaggcgctgtggctcacacctataatcccagcactttaggaggccgaggcaggcggattgcctgagctcaggagttcaagatcagtctgggcaacacgatgaaactccgtctctactaaaatacaaaaaattatccaggcatggtggcgtacgcctgtagtcccagctactcaggaggctgaggcaggagaattgcttgaacccaggaggaagaggttgcagtgagccaagatcatgccacatcactccaacctgggcaacagaacaagaacccatctcaaacaaacaaacaaacaaacaaaaaaaaactcttgtctccttaggatatgttacctgctccactgcagactagagaaataaatgtgtattgaaccttttactgcaaacttgaaaatgctagaaaaccaagcatgaagaataaatacatggcgggaaacacacaggcatgtgcatatgcatatacattgtaagttagtaagttagaaagctagctttgttgtatctgaacacatgaatcttttttggtcagtgtaggaagcacagccagatcctataggaatgaatacctcaaatctgttgtctgagattctagagattaaaccactgtgccatttttaacccaggctgtactgttgtttcttaccaacagcataggttttcatcactggaaggagcctgtgttcatttcctagggctgctgtagcaaagtagtacaaactggattgtttaaaccaacaaaaactcattgtctctcagttctggaggccagaagttcaaaatcaaggtgttgaccaaggccattctcctgaaagtgctagggaaggagctgtccacgcctccctcctggcttctgggagcctcaggtgttccttggcttctagatgcatcattccagtcctccatcttcacatggcattccctctgtgtgtctccacagtgtcttccctctgtgcagatctatctctgtgtccaagtctcctctttttataaggaaaccagtcataatggacccacctgaatgacctcattttaacttgattacctctgtaaaaaatgtatttccaaataaagtgaccttatgaggtattgaaaatta

SEQ ID NO: 322361 - DNA, 2306 bp, Homo sapiens
gcgcgggttccggggctgaggggctgaggggcccaaggcgataaccgggatccgctccggccgcgctcctcttgcctttgagaagccccggaagtggcccggctgttggccgcagcgggaggtcttcggaaagaaaaggccggaaccagaagatagactcaacagcgatgccctacccggaccccgccggcctcacaccccggccagccagccgccagtagtgcgcaccgcctcctccccaagccccgccctgcgtccaccccaggggttaactcgcacgcgcgctcttgtggcggaggtagagtgcgccgtccagggctagagcaagcgcggccccgcggcccggagccatgctgaggagctgcgccgcgcgcctccgcacgctgggggctctgtgccggccgccagtaggccggcgcctgccgggaagcgagccgcgacccgagctgaggtcattttcttctgaggaagtcattcttaaggactgttctgtccccaaccccagctggaacaaggacctaagactgctctttgaccagtttatgaagaaatgtgaagatggctcctggaaacgtttgccttcatataaacgtacacctactgaatggattcaagacttcaaaacccattttcttgacccaaagcttatgaaagaagaacaaatgtcacaggcccagctcttcaccagaagctttgatgatggcctgggctttgaatacgtgatgttctacaatgacattgagaaaaggatggtttgcttatttcaaggaggcccttacctggaaggaccacctggattcattcatggaggtgccattgcaaccatgattgatgctactgttggtatgtgtgcaatgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaaatactctgctccctcactgctgaatccctgtagggagaagcctgccaacagtgaccttccgaaacagccttctgaatacaaagaggattcagtttccatcttctcaactttttaacacagaaacacttcctgcgagcatatcgacaactctcgggccaggcgctgtggctcacacctataatcccagcactttaggaggccgaggcaggcggattgcctgagctcaggagttcaagatcagtctgggcaacacgatgaaactccgtctctactaaaatacaaaaaattatccaggcatggtggcgtacgcctgtagtcccagctactcaggaggctgaggcaggagaattgcttgaacccaggaggaagaggttgcagtgagccaagatcatgccacatcactccaacctgggcaacagaacaagaacccatctcaaacaaacaaacaaacaaacaaaaaaaaactcttgtctccttaggatatgttacctgctccactgcagactagagaaataaatgtgtattgaaccttttactgcaaacttgaaaatgctagaaaaccaagcatgaagaataaatacatggcgggaaacacacaggcatgtgcatatgcatatacattgtaagttagtaagttagaaagctagctttgttgtatctgaacacatgaatcttttttggtcagtgtaggaagcacagccagatcctataggaatgaatacctcaaatctgttgtctgagattctagagattaaaccactgtgccatttttaacccaggctgtactgttgtttcttaccaacagcataggttttcatcactggaaggagcctgtgttcatttcctagggctgctgtagcaaagtagtacaaactggattgtttaaaccaacaaaaactcattgtctctcagttctggaggccagaagttcaaaatcaaggtgttccttggcttctagatgcatcattccagtcctccatcttcacatggcattccctctgtgtgtctccacagtgtcttccctctgtgcagatctatctctgtgtccaagtctcctctttttataaggaaaccagtcataatggacccacctgaatgacctcattttaacttgattacctctgtaaaaaatgtatttccaaataaagtgaccttatgaggtattgaaaatta

SEQ ID NO: 322362 - DNA, 2471 bp, Homo sapiens
gcgcgggttccggggctgaggggctgaggggcccaaggcgataaccgggatccgctccggccgcgctcctcttgcctttgagaagccccggaagtggcccggctgttggccgcagcgggaggtcttcggaaagaaaaggccggaaccagaagatagactcaacagcgatgccctacccggaccccgccggcctcacaccccggccagccagccgccagtagtgcgcaccgcctcctccccaagccccgccctgcgtccaccccaggggttaactcgcacgcgcgctcttgtggcggaggtagagtgcgccgtccagggctagagcaagcgcggccccgcggcccggagccatgctgaggagctgcgccgcgcgcctccgcacgctgggggctctgtgccggccgccagtaggccggcgcctgccgggaagcgagccgcgacccgagctggtgcataattcaggattacatactgtgtcggaattgatgggttcttggtctcactgacttcaagaaagaagccacggaccctcatgaggtcattttcttctgaggaagtcattcttaaggactgttctgtccccaaccccagctggaacaaggacctaagactgctctttgaccagtttatgaagaaatgtgaagatggctcctggaaacgtttgccttcatataaacgtacacctactgaatggattcaagacttcaaaacccattttcttgacccaaagcttatgaaagaagaacaaatgtcacaggcccagctcttcaccagaagctttgatgatggcctgggctttgaatacgtgatgttctacaatgacattgagaaaaggatggtttgcttatttcaaggaggcccttacctggaaggaccacctggattcattcatggaggtgccattgcaaccatgattgatgctactgttggtatgtgtgcaatgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaaatactctgctccctcactgctgaatccctgtagggagaagcctgccaacagtgaccttccgaaacagccttctgaatacaaagaggattcagtttccatcttctcaactttttaacacagaaacacttcctgcgagcatatcgacaactctcgggccaggcgctgtggctcacacctataatcccagcactttaggaggccgaggcaggcggattgcctgagctcaggagttcaagatcagtctgggcaacacgatgaaactccgtctctactaaaatacaaaaaattatccaggcatggtggcgtacgcctgtagtcccagctactcaggaggctgaggcaggagaattgcttgaacccaggaggaagaggttgcagtgagccaagatcatgccacatcactccaacctgggcaacagaacaagaacccatctcaaacaaacaaacaaacaaacaaaaaaaaactcttgtctccttaggatatgttacctgctccactgcagactagagaaataaatgtgtattgaaccttttactgcaaacttgaaaatgctagaaaaccaagcatgaagaataaatacatggcgggaaacacacaggcatgtgcatatgcatatacattgtaagttagtaagttagaaagctagctttgttgtatctgaacacatgaatcttttttggtcagtgtaggaagcacagccagatcctataggaatgaatacctcaaatctgttgtctgagattctagagattaaaccactgtgccatttttaacccaggctgtactgttgtttcttaccaacagcataggttttcatcactggaaggagcctgtgttcatttcctagggctgctgtagcaaagtagtacaaactggattgtttaaaccaacaaaaactcattgtctctcagttctggaggccagaagttcaaaatcaaggtgttgaccaaggccattctcctgaaagtgctagggaaggagctgtccacgcctccctcctggcttctgggagcctcaggtgttccttggcttctagatgcatcattccagtcctccatcttcacatggcattccctctgtgtgtctccacagtgtcttccctctgtgcagatctatctctgtgtccaagtctcctctttttataaggaaaccagtcataatggacccacctgaatgacctcattttaacttgattacctctgtaaaaaatgtatttccaaataaagtgaccttatgaggtattgaaaatta

SEQ ID NO: 322363 - DNA, 1905 bp, Homo sapiens
gcgcgggttccggggctgaggggctgaggggcccaaggcgataaccgggatccgctccggccgcgctcctcttgcctttgagaagccccggaagtggcccggctgttggccgcagcgggaggtcttcggaaagaaaaggccggaaccagaagatagactcaacagcgatgccctacccggaccccgccggcctcacaccccggccagccagccgccagtagtgcgcaccgcctcctccccaagccccgccctgcgtccaccccaggggttaactcgcacgcgcgctcttgtggcggaggtagagtgcgccgtccagggctagagcaagcgcggccccgcggcccggagccatgctgaggagctgcgccgcgcgcctccgcacgctgggggctctgtgccggccgccagtaggccggcgcctgccgggaagcgagccgcgacccgagctgaggtcattttcttctgaggaagtcattcttaaggactgttctgtccccaaccccagctggaacaaggacctaagactgctctttgaccagtttatgaagaaatgtgaagatggctcctggaaacgtttgccttcatataaacgtacacctactgaatggattcaagacttcaaaacccattttcttgacccaaagcttatgaaagaagaacaaatgtcacaggcccagctcttcaccagaagctttgatgatggcctgggctttgaatacgtgatgttctacaatgacattgagaaaaggatggtttgcttatttcaaggaggcccttacctggaaggaccacctggattcattcatggaggtgccattgcaaccatgattgatgctactgttggtatgtgtgcaatgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaaatactctgctccctcactgctgaatccctgtagggagaagcctgccaacagtgaccttccgaaacagccttctgaatacaaagaggattcagtttccatcttctcaactttttaacacagaaacacttcctgcgagcatatcgacaactctcgggccaggcgctgtggctcacacctataatcccagcactttaggaggccgaggcaggcggattgcctgagctcaggagttcaagatcagtctgggcaacacgatgaaactccgtctctactaaaatacaaaaaattatccaggcatggtggcgtacgcctgtagtcccagctactcaggaggctgaggcaggagaattgcttgaacccaggaggaagaggttgcagtgagccaagatcatgccacatcactccaacctgggcaacagaacaagaacccatctcaaacaaacaaacaaacaaacaaaaaaaaactcttgtctccttaggatatgttacctgctccactgcagactagagaaataaatgtgtattgaaccttttactgcaaacttgaaaatgctagaaaaccaagcatgaagaataaatacatggcgggaaacacacaggcatgtgcatatgcatatacattgtaagttagtaagttagaaagctagctttgttgtatctgaacacatgaatcttttttggtcagtgtaggaagcacagccagatcctataggaatgaatacctcaaatctgttgtctgagattctagagattaaaccactgtgccattttt

SEQ ID NO: 322364 - DNA, 2250 bp, Homo sapiens
gcgcgggttccggggctgaggggctgaggggcccaaggcgataaccgggatccgctccggccgcgctcctcttgcctttgagaagccccggaagtggcccggctgttggccgcagcgggaggtcttcggaaagaaaaggccggaaccagaagatagactcaacagcgatgccctacccggaccccgccggcctcacaccccggccagccagccgccagtagtgcgcaccgcctcctccccaagccccgccctgcgtccaccccaggggttaactcgcacgcgcgctcttgtggcggaggtagagtgcgccgtccagggctagagcaagcgcggccccgcggcccggagccatgctgaggagctgcgccgcgcgcctccgcacgctgggggctctgtgccggccgccagtaggccggcgcctgccgggaagcgagccgcgacccgagctgaggtcattttcttctgaggaagtcattcttaaggactgttctgtccccaaccccagctggaacaaggacctaagactgctctttgaccagtttatgaagaaatgtgaagatggctcctggaaacgtttgccttcatataaacgtacacctactgaatggattcaagacttcaaaacccattttcttgacccaaagcttatgaaagaagaacaaatgtcacaggcccagctcttcaccagaagctttgatgatggcctgggctttgaatacgtgatgttctacaatgacattgagaaaaggatggtttgcttatttcaaggaggcccttacctggaaggaccacctggattcattcatggaggtgccattgcaaccatgattgatgctactgttggtatgtgtgcaatgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaaatactctgctccctcactgctgaatccctgtagggagaagcctgccaacagtgaccttccgaaacagccttctgaatacaaagaggattcagtttccatcttctcaactttttaacacagaaacacttcctgcgagcatatcgacaactctcgggccaggcgctgtggctcacacctgtagtcccagctactcaggaggctgaggcaggagaattgcttgaacccaggaggaagaggttgcagtgagccaagatcatgccacatcactccaacctgggcaacagaacaagaacccatctcaaacaaacaaacaaacaaacaaaaaaaaactcttgtctccttaggatatgttacctgctccactgcagactagagaaataaatgtgtattgaaccttttactgcaaacttgaaaatgctagaaaaccaagcatgaagaataaatacatggcgggaaacacacaggcatgtgcatatgcatatacattgtaagttagtaagttagaaagctagctttgttgtatctgaacacatgaatcttttttggtcagtgtaggaagcacagccagatcctataggaatgaatacctcaaatctgttgtctgagattctagagattaaaccactgtgccatttttaacccaggctgtactgttgtttcttaccaacagcataggttttcatcactggaaggagcctgtgttcatttcctagggctgctgtagcaaagtagtacaaactggattgtttaaaccaacaaaaactcattgtctctcagttctggaggccagaagttcaaaatcaaggtgttgaccaaggccattctcctgaaagtgctagggaaggagctgtccacgcctccctcctggcttctgggagcctcaggtgttccttggcttctagatgcatcattccagtcctccatcttcacatggcattccctctgtgtgtctccacagtgtcttccctctgtgcagatctatctctgtgtccaagtctcctctttttataaggaaaccagtcataatggacccacctgaatgacctcattttaacttgattacctctgtaaaaaatgtatttccaaataaagtgaccttatgaggtattgaaaatta

SEQ ID NO: 322365 - DNA, 615 bp, Homo sapiens
cctggtggtactcctccagaactgaacacatgaatcttttttggtcagtgtaggaagcacagccagatcctataggaatgaatacctcaaatctgttgtctgagattctagagattaaaccactgtgccatttttaacccaggctgtactgttgtttcttaccaacagcataggttttcatcactggaaggagcctgtgttcatttcctagggctgctgtagcaaagtagtacaaactggattgtttaaaccaacaaaaactcattgtctctcagttctggaggccagaagttcaaaatcaaggtgttgaccaaggccattctcctgaaagtgctagggaaggagctgtccacgcctccctcctggcttctgggagcctcaggtgttccttggcttctagatgcatcattccagtcctccatcttcacatggcattccctctgtgtgtctccacagtgtcttccctctgtgcagatctatctctgtgtccaagtctcctctttttataaggaaaccagtcataatggacccacctgaatgacctcattttaacttgattacctctgtaaaaaatgtatttccaaataaagtgaccttatgaggtattgaaaatta

SEQ ID NO: 322366 - DNA, 941 bp, Homo sapiens
ggcttagagtcacaatcacttgagtgttgggctgaactgaccctgttgctgattcagactcaactcatgtctgccagggaaacctcctttctgttacattttttattttctgtaaattgcatttaaaccacagttcttccaagaaggatttccgtctttaccgtaccattttattcagtatattgttagcgtttatatactatattcctgattgccatgtgtgggtacttcattttgatttcatgtctgtttactctgtccccagttggactgttaattccacaagggcaaagatcctatcttctgtttcattgagacgctcccattcctttcaattttgcaccctgtggacatttgaatcaatcatctattgacatgtgattctagcagggtacaggtgcttggctctgccatggcatttctctcacccttgtttctcatttgccatccacctcattttctatagacccaaagcttatgaaagaagaacaaatgtcacaggcccagctcttcaccagaagctttgatgatggcctgggctttgaatacgtgatgttctacaatgacattgagaaaaggatggtttgcttatttcaaggaggcccttacctggaaggaccacctggattcattcatggaggtgccattgcaaccatgattgatgctactgttggtatgtgtgcaatgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcgggatctctagatcgactgcagctgcaagctggctggcgcgtcatccagggaaaaaaaaaaaagggaaaaaaattac

SEQ ID NO: 322367 - DNA, 2617 bp, Homo sapiens
gcgcgggttccggggctgaggggctgaggggcccaaggcgataaccgggatccgctccggccgcgctcctcttgcctttgagaagccccggaagtggcccggctgttggccgcagcgggaggtcttcggaaagaaaaggccggaaccagaagatagactcaacagcgatgccctacccggaccccgccggcctcacaccccggccagccagccgccagtagtgcgcaccgcctcctccccaagccccgccctgcgtccaccccaggggttaactcgcacgcgcgctcttgtggcggaggtagagtgcgccgtccagggctagagcaagcgcggccccgcggcccggagccatgctgaggagctgcgccgcgcgcctccgcacgctgggggctctgtgccggccgccagtaggccggcgcctgccgggaagcgagccgcgacccgagctgaggtcattttcttctgaggaagtcattcttaaggactgttctgtccccaaccccagctggaacaaggacctaagactgctctttgaccagtttatgaagaaatgtgaagatggctcctggaaacgtttgccttcatataaacgtacacctactgaatggattcaagacttcaaaacccattttcttgcctggttaatggccgggcgctgtggctcacgcctataatcccagcactttgggaggccaaggcaggcggatccctgagttcgggagttcaagaccagcctgaccaacacggagaaaccccgtctctactaaaaatacagaattagtcaggcgtggtggtgggcgcctgtaatcccagctactcaggaggctgaggcaggagaatcgcttgaacccgggaggcggaggttgcgacccaaagcttatgaaagaagaacaaatgtcacaggcccagctcttcaccagaagctttgatgatggcctgggctttgaatacgtgatgttctacaatgacattgagaaaaggatggtttgcttatttcaaggaggcccttacctggaaggaccacctggattcattcatggaggtgccattgcaaccatgattgatgctactgttggtatgtgtgcaatgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaaatactctgctccctcactgctgaatccctgtagggagaagcctgccaacagtgaccttccgaaacagccttctgaatacaaagaggattcagtttccatcttctcaactttttaacacagaaacacttcctgcgagcatatcgacaactctcgggccaggcgctgtggctcacacctataatcccagcactttaggaggccgaggcaggcggattgcctgagctcaggagttcaagatcagtctgggcaacacgatgaaactccgtctctactaaaatacaaaaaattatccaggcatggtggcgtacgcctgtagtcccagctactcaggaggctgaggcaggagaattgcttgaacccaggaggaagaggttgcagtgagccaagatcatgccacatcactccaacctgggcaacagaacaagaacccatctcaaacaaacaaacaaacaaacaaaaaaaaactcttgtctccttaggatatgttacctgctccactgcagactagagaaataaatgtgtattgaaccttttactgcaaacttgaaaatgctagaaaaccaagcatgaagaataaatacatggcgggaaacacacaggcatgtgcatatgcatatacattgtaagttagtaagttagaaagctagctttgttgtatctgaacacatgaatcttttttggtcagtgtaggaagcacagccagatcctataggaatgaatacctcaaatctgttgtctgagattctagagattaaaccactgtgccatttttaacccaggctgtactgttgtttcttaccaacagcataggttttcatcactggaaggagcctgtgttcatttcctagggctgctgtagcaaagtagtacaaactggattgtttaaaccaacaaaaactcattgtctctcagttctggaggccagaagttcaaaatcaaggtgttgaccaaggccattctcctgaaagtgctagggaaggagctgtccacgcctccctcctggcttctgggagcctcaggtgttccttggcttctagatgcatcattccagtcctccatcttcacatggcattccctctgtgtgtctccacagtgtcttccctctgtgcagatctatctctgtgtccaagtctcctctttttataaggaaaccagtcataatggacccacctgaatgacctcattttaacttgattacctctgtaaaaaatgtatttccaaataaagtgaccttatgaggtattgaaaatta

SEQ ID NO: 322368 - DNA, 2215 bp, Homo sapiens
ggcttagagtcacaatcacttgagtgttgggctgaactgaccctgttgctgattcagactcaactcatgtctgccagggaaacctcctttctgttacattttttattttctgtaaattgcatttaaaccacagttcttccaagaaggatttccgtctttaccgtaccattttattcagtatattgttagcgtttatatactatattcctgattgccatgtgtgggtacttcattttgatttcatgtctgtttactctgtccccagttggactgttaattccacaagggcaaagatcctatcttctgtttcattgagacgctcccattcctttcaattttgcaccctgtggacatttgaatcaatcatctattgacatgtgattctagcagggtacaggtgcttggctctgccatggcatttctctcacccttgtttctcatttgccatccacctcattttctatagacccaaagcttatgaaagaagaacaaatgtcacaggcccagctcttcaccagaagctttgatgatggcctgggctttgaatacgtgatgttctacaatgacattgagaaaaggatggtttgcttatttcaaggaggcccttacctggaaggaccacctggattcattcatggaggtgccattgcaaccatgattgatgctactgttggtatgtgtgcaatgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaaatactctgctccctcactgctgaatccctgtagggagaagcctgccaacagtgaccttccgaaacagccttctgaatacaaagaggattcagtttccatcttctcaactttttaacacagaaacacttcctgcgagcatatcgacaactctcgggccaggcgctgtggctcacacctataatcccagcactttaggaggccgaggcaggcggattgcctgagctcaggagttcaagatcagtctgggcaacacgatgaaactccgtctctactaaaatacaaaaaattatccaggcatggtggcgtacgcctgtagtcccagctactcaggaggctgaggcaggagaattgcttgaacccaggaggaagaggttgcagtgagccaagatcatgccacatcactccaacctgggcaacagaacaagaacccatctcaaacaaacaaacaaacaaacaaaaaaaaactcttgtctccttaggatatgttacctgctccactgcagactagagaaataaatgtgtattgaaccttttactgcaaacttgaaaatgctagaaaaccaagcatgaagaataaatacatggcgggaaacacacaggcatgtgcatatgcatatacattgtaagttagtaagttagaaagctagctttgttgtatctgaacacatgaatcttttttggtcagtgtaggaagcacagccagatcctataggaatgaatacctcaaatctgttgtctgagattctagagattaaaccactgtgccatttttaacccaggctgtactgttgtttcttaccaacagcataggttttcatcactggaaggagcctgtgttcatttcctagggctgctgtagcaaagtagtacaaactggattgtttaaaccaacaaaaactcattgtctctcagttctggaggccagaagttcaaaatcaaggtgttgaccaaggccattctcctgaaagtgctagggaaggagctgtccacgcctccctcctggcttctgggagcctcaggtgttccttggcttctagatgcatcattccagtcctccatcttcacatggcattccctctgtgtgtctccacagtgtcttccctctgtgcagatctatctctgtgtccaagtctcctctttttataaggaaaccagtcataatggacccacctgaatgacctcattttaacttgattacctctgtaaaaaatgtatttccaaataaagtgaccttatgaggtattgaaaatta

SEQ ID NO: 322369 - DNA, 2105 bp, Homo sapiens
caatccagttcccccaacttgctcacaattgtgtaagtgaaaaaaaactgtgtctaaacaagtgcactattacttacccagagtatatggttctgttaactaagtgttctgtttctttttaaagcctggttaatggccgggcgctgtggctcacgcctataatcccagcactttgggaggccaaggcaggcggatccctgagttcgggagttcaagaccagcctgaccaacacggagaaaccccgtctctactaaaaatacagaattagtcaggcgtggtggtgggcgcctgtaatcccagctactcaggaggctgaggcaggagaatcgcttgaacccgggaggcggaggttgcgacccaaagcttatgaaagaagaacaaatgtcacaggcccagctcttcaccagaagctttgatgatggcctgggctttgaatacgtgatgttctacaatgacattgagaaaaggatggtttgcttatttcaaggaggcccttacctggaaggaccacctggattcattcatggaggtgccattgcaaccatgattgatgctactgttggtatgtgtgcaatgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaaatactctgctccctcactgctgaatccctgtagggagaagcctgccaacagtgaccttccgaaacagccttctgaatacaaagaggattcagtttccatcttctcaactttttaacacagaaacacttcctgcgagcatatcgacaactctcgggccaggcgctgtggctcacacctataatcccagcactttaggaggccgaggcaggcggattgcctgagctcaggagttcaagatcagtctgggcaacacgatgaaactccgtctctactaaaatacaaaaaattatccaggcatggtggcgtacgcctgtagtcccagctactcaggaggctgaggcaggagaattgcttgaacccaggaggaagaggttgcagtgagccaagatcatgccacatcactccaacctgggcaacagaacaagaacccatctcaaacaaacaaacaaacaaacaaaaaaaaactcttgtctccttaggatatgttacctgctccactgcagactagagaaataaatgtgtattgaaccttttactgcaaacttgaaaatgctagaaaaccaagcatgaagaataaatacatggcgggaaacacacaggcatgtgcatatgcatatacattgtaagttagtaagttagaaagctagctttgttgtatctgaacacatgaatcttttttggtcagtgtaggaagcacagccagatcctataggaatgaatacctcaaatctgttgtctgagattctagagattaaaccactgtgccatttttaacccaggctgtactgttgtttcttaccaacagcataggttttcatcactggaaggagcctgtgttcatttcctagggctgctgtagcaaagtagtacaaactggattgtttaaaccaacaaaaactcattgtctctcagttctggaggccagaagttcaaaatcaaggtgttgaccaaggccattctcctgaaagtgctagggaaggagctgtccacgcctccctcctggcttctgggagcctcaggtgttccttggcttctagatgcatcattccagtcctccatcttcacatggcattccctctgtgtgtctccacagtgtcttccctctgtgcagatctatctctgtgtccaagtctcctctttttataaggaaaccagtcataatggacccacctgaatgacctcattttaacttgattacctctgtaaaaaatgtatttccaaataaagtgaccttatgaggtattgaaaatta

SEQ ID NO: 322370 - DNA, 810 bp, Homo sapiens
gcgcgggttccggggctgaggggctgaggggcccaaggcgataaccgggatccgctccggccgcgctcctcttgcctttgagaagccccggaagtggcccggctgttggccgcagcgggaggtcttcggaaagaaaaggccggaaccagaagatagactcaacagcgatgccctacccggaccccgccggcctcacaccccggccagccagccgccagtagtgcgcaccgcctcctccccaagccccgccctgcgtccaccccaggggttaactcgcacgcgcgctcttgtggcggaggtagagtgcgccgtccagggctagagcaagcgcggccccgcggcccggagccatgctgaggagctgcgccgcgcgcctccgcacgctgggggctctgtgccggccgccagtaggccggcgcctgccgggaagcgagccgcgacccgagctgaggtcattttcttctgaggaagtcattcttaaggactgttctgtccccaaccccagctggaacaaggacctaagactgctctttgaccagtttatgaagaaatgtgaagatggctcctggaaacgtttgccttcatataaacgtacacctactgaatggattcaagacttcaaaacccattttcttggtagaaacagccactttcccattaatatatctgagcatcaaatataaagctaagaacagattgaagtactagttactacctgaaaaaaagaaagaatataatgcaggattatggttctatagtcaccaattttatagaccagaaatcacaataaattttgcagattggagagca

SEQ ID NO: 322371 - DNA, 1507 bp, Homo sapiens
cttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatgtggagagaaaggagaaaaatcagaattctatttgtaaatctgctt

SEQ ID NO: 322372 - DNA, 485 bp, Homo sapiens
tatttttaattttagaaatatcacagttccattgcaatattccctttaatttactatttttaaaggggtattgtaaatatgaaagtatttataaagtgaattgctattttttctgttcagaaaagtacacacttaaaattgttattgttaacaatgtgtaaacacatttaaaattgttattgttaacaaagaaatcatggagaactgtagaggttttcacagtggatccattttctgacagttttctactatctattaaatcatatctgcttaaatatatagcttctatctgtctttaaatcttctcattaaaatgtataagcagtgactttgatctcaaaaataggtaatttttctttgccgacctgtaaaagtgtgccaatacactaaatttgtgattttaaattaattcctccagctgttgaaatgaagtctgccaaatcttgctctaacaaataaaatgttatctaaatgaaaaaattccg

SEQ ID NO: 322373 - DNA, 2908 bp, Homo sapiens
ctccgccgcgctctccgccaccgcaccactgcggcaccgcaatgaaacgcctcccgctcctagtggttttttccacttgttgaattgttcctatactcaaaattgcaccaagacaccttgtctcccaaatgcaaaatgtgaaatacgcaatggaattgaagcctgctattgcaacatgggattttcaggaaatggtgtcacaattgtgaagatgataatgaatgtggaaatttaactcagtcctgtggcgaaaatgctaattgcactaacacagaaggaagttattattgtatgtgtgtacctggcttcagatccagcagtaaccaagacaggtttatcactaatgatggaaccgtctgtatagaaaatgtgaatgcaaactgccatttagataatgtctgtatagctgcaaatattaataaaactttaacaaaaatcagatccataaaagaacctgtggctttgctacaagaagtctatagaaattctgtgacagatctttcaccaacagatataattacatatatagaaatattagctgaatcatcttcattactaggttacaagaacaacactatctcagccaaggacaccctttctaactcaactcttactgaatttgtaaaaaccgtgaataattttgttcaaagggatacatttgtagtttgggacaagttatctgtgaatcataggagaacacatcttacaaaactcatgcacactgttgaacaagctactttaaggatatcccagagcttccaaaagaccacagagtttgatacaaattcaacggatatagctctcaaagttttcttttttgattcatataacatgaaacatattcatcctcatatgaatatggatggagactacataaatatatttccaaagagaaaagctgcatatgattcaaatggcaatgttgcagttgcatttttatattataagagtattggtcctttgctttcatcatctgacaacttcttattgaaacctcaaaattatgataattctgaagaggaggaaagagtcatatcttcagtaatttcagtctcaatgagctcaaacccacccacattatatgaacttgaaaaaataacatttacattaagtcatcgaaaggtcacagataggtataggagtctatgtgcattttggaattactcacctgataccatgaatggcagctggtcttcagagggctgtgagctgacatactcaaatgagacccacacctcatgccgctgtaatcacctgacacattttgcaattttgatgtcctctggtccttccattggtattaaagattataatattcttacaaggatcactcaactaggaataattatttcactgatttgtcttgccatatgcatttttaccttctggttcttcagtgaaattcaaagcaccaggacaacaattcacaaaaatctttgctgtagcctatttcttgctgaacttgtttttcttgttgggatcaatacaaatactaataagctcttctgttcaatcattgccggactgctacactacttctttttagctgcttttgcatggatgtgcattgaaggcatacatctctatctcattgttgtgggtgtcatctacaacaagggatttttgcacaagaatttttatatctttggctatctaagcccagccgtggtagttggattttcggcagcactaggatacagatattatggcacaaccaaagtatgttggcttagcaccgaaaacaactttatttggagttttataggaccagcatgcctaatcattcttgttaatctcttggcttttggagtcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaaacatagagaatggtggataattacaactgcacaaaaataaaaattccaagctgtggatgaccaatgtataaaaatgactcatcaaattatccaattattaactactagacaaaaagtattttaaatcagtttttctgtttatgctataggaactgtagataataaggtaaaattatgtatcatatagatatactatgtttttctatgtgaaatagttctgtcaaaaatagtattgcagatatttggaaagtaattggtttctcaggagtgatatcactgcacccaaggaaagattttctttctaacacgagaagtatatgaatgtcctgaaggaaaccactggcttgatatttctgtgactcgtgttgcctttgaaactagtcccctaccacctcggtaatgagctccattacagaaagtggaacataagagaatgaaggggcagaatatcaaacagtgaaaagggaatgataagatgtattttgaatgaactgttttttctgtagactagctgagaaattgttgacataaaataaagaattgaagaaacacattttaccattttgtgaattgttctgaacttaaatgtccactaaaacaacttagacttctgtttgctaaatctgtttctttttctaatattctaaaaaaaacaaaaaggtttacctccacaaattgaaaaaaaaaaagtgaaaaaaatctgtttctaaggttagactgagatatatactatttccttacttatttcacagattgtgactttggatagttaatcagtaaaatataaatgtgtcaa

SEQ ID NO: 322374 - DNA, 1178 bp, Homo sapiens
atatagtaagacatagcatcataaaattaagtatttggcataaacaaacaacctccaggttaatctcttggcttttggagtcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaaacatagagaatggtggataattacaactgcacaaaaataaaaattccaagctgtggatgaccaatgtataaaaatgactcatcaaattatccaattattaactactagacaaaaagtattttaaatcagtttttctgtttatgctataggaactgtagataataaggtaaaattatgtatcatatagatatactatgtttttctatgtgaaatagttctgtcaaaaatagtattgcagatatttggaaagtaattggtttctcaggagtgatatcactgcacccaaggaaagattttctttctaacacgagaagtatatgaatgtcctgaaggaaaccactggcttgatatttctgtgactcgtgttgcctttgaaactagtcccctaccacctcggtaatgagctccattacagaaagtggaacataagagaatgaaggggcagaatatcaaacagtgaaaagggaatgataagatgtattttgaatgaactgttttttctgtagactagctgagaaattgttgacataaaataaagaattgaagaaacacattttaccattttgtgaattgttctgaacttaaatgtccactaaaacaacttagacttctgtttgctaaatctgtttctttttctaatattctaaaaaaaacaaaaaggtttacctccacaaattgaaaaaaaaaaagtgaaaaaaatctgtttctaaggttagactgagatatatactatttccttacttatttcacagattgtgactttggatagttaatcagtaaaatataaatgtgtcaa

SEQ ID NO: 322375 - DNA, 933 bp, Homo sapiens
atatagtaagacatagcatcataaaattaagtatttggcataaacaaacaacctccaggttaatctcttggcttttggagtcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaaacatagagaatggtggataattacaactgcacaaaaataaaaattccaagctgtggatgaccaatgtataaaaatgactcatcaaattatccaattattaactactagacaaaaagtattttaaatcagtttttctgtttatgctataggaactgtagataataaggtaaaattatgtatcatatagatatactatgtttttctatgtgaaatagttctgtcaaaaatagtattgcagatatttggaaagtaattggtttctcaggagtgatatcactgcacccaaggaaagattttctttctaacacgagaagtatatgaatgtcctgaaggaaaccactggcttgatatttctgtgactcgtgttgcctttgaaactagtcccctaccacctcggtaatgagctccattacagaaagtggaacataagagaatgaaggggcagaatatcaaacagtgaaaagggaatgataagatgtattttgaatgaactgttttttctgtagactagctgagaaattgttgacataaaataaagaattgaagaaaca

SEQ ID NO: 322376 - DNA, 2175 bp, Homo sapiens
ctccgccgcgctctccgccaccgcaccactgcggcaccgcaatgaaacgcctcccgctcctagtggttttttccacttgttgaattgttcctatactcaaaattgcaccaagacaccttgtctcccaaatgcaaaatgtgaaatacgcaatggaattgaagcctgctattgcaacatgggattttcaggaaatggtgtcacaattgtgaagatgataatgaatgtggaaatttaactcagtcctgtggcgaaaatgctaattgcactaacacagaaggaagttattattgtatgtgtgtacctggcttcagatccagcagtaaccaagacaggtttatcactaatgatggaaccgtctgtatagaaaatgtgaatgcaaactgccatttagataatgtctgtatagctgcaaatattaataaaactttaacaaaaatcagatccataaaagaacctgtggctttgctacaagaagtctatagaaattctgtgacagatctttcaccaacagatataattacatatatagaaatattagctgaatcatcttcattactaggttacaagaacaacactatctcagccaaggacaccctttctaactcaactcttactgaatttgtaaaaaccgtgaataattttgttcaaagggatacatttgtagtttgggacaagttatctgtgaatcataggagaacacatcttacaaaactcatgcacactgttgaacaagctactttaaggatatcccagagcttccaaaagaccacagagtttgatacaaattcaacggatatagctctcaaagttttcttttttgattcatataacatgaaacatattcatcctcatatgaatatggatggagactacataaatatatttccaaagagaaaagctgcatatgattcaaatggcaatgttgcagttgcatttttatattataagagtattggtcctttgctttcatcatctgacaacttcttattgaaacctcaaaattatgataattctgaagaggaggaaagagtcatatcttcagtaatttcagtctcaatgagctcaaacccacccacattatatgaacttgaaaaaataacatttacattaagtcatcgaaaggtcacagataggtataggagtctatgtgcattttggaattactcacctgataccatgaatggcagctggtcttcagagggctgtgagctgacatactcaaatgagacccacacctcatgccgctgtaatcacctgacacattttgcaattttgatgtcctctggtccttccattggtattaaagattataatattcttacaaggatcactcaactaggaataattatttcactgatttgtcttgccatatgcatttttaccttctggttcttcagtgaaattcaaagcaccaggacaacaattcacaaaaatctttgctgtagcctatttcttgctgaacttgtttttcttgttgggatcaatacaaatactaataagctcttctgttcaatcattgccggactgctacactacttctttttagctgcttttgcatggatgtgcattgaaggcatacatctctatctcattgttgtgggtgtcatctacaacaagggatttttgcacaagaatttttatatctttggctatctaagcccagccgtggtagttggattttcggcagcactaggatacagatattatggcacaaccaaagtatgttggcttagcaccgaaaacaactttatttggagttttataggaccagcatgcctaatcattcttgttaatctcttggcttttggagtcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaagctgttgaaatgaagtctgccaaatcttgctctaacaaataaaatgttatctaaatgaaaaaattccg

SEQ ID NO: 322377 - DNA, 581 bp, Homo sapiens
tggaaaaaagaattcgttaatatattcagtatatattcatatcaaagcaaagaagaatatctgccaaactattgtagttctcattttctgtacctttcatgtgatcatggcaggtatctgtcatttctttcttcctctagccattccatgttcctttggtcctcagtagtcacctcagatggtctttgttctttgcctggtggggtggcctaaaccttcattctggggtgtatgtaccaataaatggccatattgttttgctctaatatcccgttaactttccataataaacaagtgtaatagaaaatcctaggttccaggcaatttctttccttcttccattgagtatttttttcccattgtgtattttaaacttggttcttccttgataatcgggatcaatcagcctagctattatagtacctgccttacttgtctttggctaagtggcatgaggagcaagaagtgctgagttaacagtctcagctctctgttcagtggaaataatgttgtgtctcccccaaagaagcacttctcccttgaggattaagacctgtaaactgggagagcccacagctgct

SEQ ID NO: 322378 - DNA, 782 bp, Homo sapiens
  misc_feature (729)..(729): n is a, c, g, or t
  misc_feature (771)..(771): n is a, c, g, or t
ctattggcccgcggaggtccccaccctcagcgcggccccgcccccggggtaaggagccggggcggactctgggacgctcagacgccgcgcggggcggggcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaaattaaacctccgccaaaggccnaacaagaaaccaccccggaaacaaccgccaagctttcccggncctccggcttc

SEQ ID NO: 322379 - DNA, 2707 bp, Homo sapiens
  misc_feature (2707)..(2707): n is a, c, g, or t
ctattggcccgcggaggtccccaccctcagcgcggccccgcccccggggtaaggagccggggcggactctgggacgctcagacgccgcgcggggcggggcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtcccctgcctgtgcccttcaccaatggggagatacagaaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaaaaaaaaaaaaaaaaaaaaaaaaaaaaaaaaaaaaaaaaaaaaaaaaaaaaaaaaaaaaaaaaaaaaaaaaaaaaaagaaggagggggcgcggagcgagcagagacactatctctcctcaaggagggggcgcgcccaacataactaacgagcacacacccgcgattagttagtagaaagagggcggcgcactcaaaaaaggggagagactatattaataagacgcacaggcagcagcgggcggacgccattatcataacaacaccgcgaaaggagagagggaggaacaagagggaagagaacggagggaaacactcagtgagaaggaagaacacccacaactaacatccgcggggtgaggaccaaaaatacaggcgaaggaaaaaacaagctacagcccaaacgaaaataaagaaccgcacagagaaaaggaacagaacacaaacgagaacgagcgaagcagagcaaagagcggggagagcaaaaaaaaaacgagacgggcgacagacgcaggcccgacgcgggagcggcacaaagagtaagagcgacaaaccggaagggaccgaacgagaaatcaacgaaacaaaaatcttgcaaacaccgagcgaacaaaaaaggcagacaagaagggn

SEQ ID NO: 322380 - DNA, 2667 bp, Homo sapiens
  misc_feature (2667)..(2667): n is a, c, g, or t
cacccccccggcccgcgcgtcaaaaaacatagctaggtcgaggcctggtgttaattcggcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtcccctgcctgtgcccttcaccaatggggagatacagaaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaaaaaaaaaaaaaaaaaaaaaaaaaaaaaaaaaaaaaaaaaaaaaaaaaaaaaaaaaaaaaaaaaaaaaaaaaaaaaagaaggagggggcgcggagcgagcagagacactatctctcctcaaggagggggcgcgcccaacataactaacgagcacacacccgcgattagttagtagaaagagggcggcgcactcaaaaaaggggagagactatattaataagacgcacaggcagcagcgggcggacgccattatcataacaacaccgcgaaaggagagagggaggaacaagagggaagagaacggagggaaacactcagtgagaaggaagaacacccacaactaacatccgcggggtgaggaccaaaaatacaggcgaaggaaaaaacaagctacagcccaaacgaaaataaagaaccgcacagagaaaaggaacagaacacaaacgagaacgagcgaagcagagcaaagagcggggagagcaaaaaaaaaacgagacgggcgacagacgcaggcccgacgcgggagcggcacaaagagtaagagcgacaaaccggaagggaccgaacgagaaatcaacgaaacaaaaatcttgcaaacaccgagcgaacaaaaaaggcagacaagaagggn

SEQ ID NO: 322381 - DNA, 2063 bp, Homo sapiens
  misc_feature (2063)..(2063): n is a, c, g, or t
ctattggcccgcggaggtccccaccctcagcgcggccccgcccccggggtaaggagccggggcggactctgggacgctcagacgccgcgcggggcggggcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatgccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaaaaaaaaaaaaaaaaaaaaaaaaaaaaaaaaaaaaaaaaaaaaaaaaaaaaaaaaaaaaaaaaaaaaaaaaaaaaaagaaggagggggcgcggagcgagcagagacactatctctcctcaaggagggggcgcgcccaacataactaacgagcacacacccgcgattagttagtagaaagagggcggcgcactcaaaaaaggggagagactatattaataagacgcacaggcagcagcgggcggacgccattatcataacaacaccgcgaaaggagagagggaggaacaagagggaagagaacggagggaaacactcagtgagaaggaagaacacccacaactaacatccgcggggtgaggaccaaaaatacaggcgaaggaaaaaacaagctacagcccaaacgaaaataaagaaccgcacagagaaaaggaacagaacacaaacgagaacgagcgaagcagagcaaagagcggggagagcaaaaaaaaaacgagacgggcgacagacgcaggcccgacgcgggagcggcacaaagagtaagagcgacaaaccggaagggaccgaacgagaaatcaacgaaacaaaaatcttgcaaacaccgagcgaacaaaaaaggcagacaagaagggn

SEQ ID NO: 322382 - DNA, 1110 bp, Homo sapiens
  misc_feature (919)..(919): n is a, c, g, or t
ctattggcccgcggaggtccccaccctcagcgcggccccgcccccggggtaaggagccggggcggactctgggacgctcagacgccgcgcggggcggggcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgacgggtctgntgggtgggagcgctggggacgtggggccgcccgggctgcggggggaccctgtgcgggggcgggagctggggttcaaagcgggggccttggagctgagccgctgctccggggatcaggagctccgatgctgacacccgggtccaggcggaaccggagcctccaatacgggcccggcctcgctctcaggccgg

SEQ ID NO: 322383 - DNA, 1585 bp, Homo sapiens
  misc_feature (1585)..(1585): n is a, c, g, or t
ttttggggggctgtcttgggaattcagctcctcgctggtgtcactggaggcggatctcaccagggctggcctggggctctccaaggctgcctctgccaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaaaaaaaaaaaaaaaaaaaaaaaaaaaaaaaaaaaaaaaaaaaaaaaaaaaaaaaaaaaaaaaaaaaaaaaaaaaaaagaaggagggggcgcggagcgagcagagacactatctctcctcaaggagggggcgcgcccaacataactaacgagcacacacccgcgattagttagtagaaagagggcggcgcactcaaaaaaggggagagactatattaataagacgcacaggcagcagcgggcggacgccattatcataacaacaccgcgaaaggagagagggaggaacaagagggaagagaacggagggaaacactcagtgagaaggaagaacacccacaactaacatccgcggggtgaggaccaaaaatacaggcgaaggaaaaaacaagctacagcccaaacgaaaataaagaaccgcacagagaaaaggaacagaacacaaacgagaacgagcgaagcagagcaaagagcggggagagcaaaaaaaaaacgagacgggcgacagacgcaggcccgacgcgggagcggcacaaagagtaagagcgacaaaccggaagggaccgaacgagaaatcaacgaaacaaaaatcttgcaaacaccgagcgaacaaaaaaggcagacaagaagggn

SEQ ID NO: 322384 - DNA, 1171 bp, Homo sapiens
  misc_feature (1171)..(1171): n is a, c, g, or t
agaccttgcccttgtaactcattgccatcaagccagtcctggtgcaggcgggtgaggacgctgaccacacgggtacgtgctgtgtactgctgcctcccgcggctttgtcttggcattatgcacctcccacgcggtcacgtaccagttaacttgactcagggtcttcggccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaaaaaaaaaaaaaaaaaaaaaaaaaaaaaaaaaaaaaaaaaaaaaaaaaaaaaaaaaaaaaaaaaaaaaaaaaaaaaagaaggagggggcgcggagcgagcagagacactatctctcctcaaggagggggcgcgcccaacataactaacgagcacacacccgcgattagttagtagaaagagggcggcgcactcaaaaaaggggagagactatattaataagacgcacaggcagcagcgggcggacgccattatcataacaacaccgcgaaaggagagagggaggaacaagagggaagagaacggagggaaacactcagtgagaaggaagaacacccacaactaacatccgcggggtgaggaccaaaaatacaggcgaaggaaaaaacaagctacagcccaaacgaaaataaagaaccgcacagagaaaaggaacagaacacaaacgagaacgagcgaagcagagcaaagagcggggagagcaaaaaaaaaacgagacgggcgacagacgcaggcccgacgcgggagcggcacaaagagtaagagcgacaaaccggaagggaccgaacgagaaatcaacgaaacaaaaatcttgcaaacaccgagcgaacaaaaaaggcagacaagaagggn

SEQ ID NO: 322385 - DNA, 1057 bp, Homo sapiens
  misc_feature (1057)..(1057): n is a, c, g, or t
atgcaaataaactagaaaatctagaagaaatggatgaattcctgcacacatccaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaaaaaaaaaaaaaaaaaaaaaaaaaaaaaaaaaaaaaaaaaaaaaaaaaaaaaaaaaaaaaaaaaaaaaaaaaaaaaagaaggagggggcgcggagcgagcagagacactatctctcctcaaggagggggcgcgcccaacataactaacgagcacacacccgcgattagttagtagaaagagggcggcgcactcaaaaaaggggagagactatattaataagacgcacaggcagcagcgggcggacgccattatcataacaacaccgcgaaaggagagagggaggaacaagagggaagagaacggagggaaacactcagtgagaaggaagaacacccacaactaacatccgcggggtgaggaccaaaaatacaggcgaaggaaaaaacaagctacagcccaaacgaaaataaagaaccgcacagagaaaaggaacagaacacaaacgagaacgagcgaagcagagcaaagagcggggagagcaaaaaaaaaacgagacgggcgacagacgcaggcccgacgcgggagcggcacaaagagtaagagcgacaaaccggaagggaccgaacgagaaatcaacgaaacaaaaatcttgcaaacaccgagcgaacaaaaaaggcagacaagaagggn

SEQ ID NO: 322386 - DNA, 1169 bp, Homo sapiens
  misc_feature (1169)..(1169): n is a, c, g, or t
cacacaaaggtcctgcgactcccatcgccagctgcaagggcccactggggaggccctgtccccttctggcgcaatccaaggcctgaggctcctagaagaggggatggcccctggaagtccctagctggctctgggcatgggaggtggggtaccgccttacccttatctcccaagttcatggaaaccaggtaactcagataatccccttctccactgagggggagactaaggcccagagaagccccagccttcctcctagggatctgatacgaggaagacacagctggaatctggattccactcagctcctggagaaatagtagatggcaagtttgtgggtttttttttacacgaatttgaggaaaaccaaatgaatttgatagccaaattgagacaatttcagccttaaacttttgttcctactcccaccctcagcgaactgggcagcacggggagggtttggctacccctgcccatccctgagccaggtaccaccattgtaaggaaacactttcagaaattcagctggttcctccaaaaaaaaaaaaaaaaaaaaaaaaaaaaaaaaaaaaaaaaaaaaaaaaaaaaaaaaaaaaaaaaaaaaaaaaaaaaaaagaaggagggggcgcggagcgagcagagacactatctctcctcaaggagggggcgcgcccaacataactaacgagcacacacccgcgattagttagtagaaagagggcggcgcactcaaaaaaggggagagactatattaataagacgcacaggcagcagcgggcggacgccattatcataacaacaccgcgaaaggagagagggaggaacaagagggaagagaacggagggaaacactcagtgagaaggaagaacacccacaactaacatccgcggggtgaggaccaaaaatacaggcgaaggaaaaaacaagctacagcccaaacgaaaataaagaaccgcacagagaaaaggaacagaacacaaacgagaacgagcgaagcagagcaaagagcggggagagcaaaaaaaaaacgagacgggcgacagacgcaggcccgacgcgggagcggcacaaagagtaagagcgacaaaccggaagggaccgaacgagaaatcaacgaaacaaaaatcttgcaaacaccgagcgaacaaaaaaggcagacaagaagggn

SEQ ID NO: 322387 - DNA, 961 bp, Homo sapiens
  misc_feature (39)..(39): n is a, c, g, or t
  misc_feature (854)..(854): n is a, c, g, or t
cggcttagcgctccgtaggccccctgggggttaatcggncgagcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgnacggggtctgcttggcggggcccccctgcggcccgtgggtcccgccaccggcggcgggccggcaccagcgcgtgtgtggcgcggcacccgcattcttccaacgtctg

SEQ ID NO: 322388 - DNA, 745 bp, Homo sapiens
cacacaaaggtcctgcgactcccatcgccagctgcaagggcccactggggaggccctgtccccttctggcgcaatccaaggcctgaggctcctagaagaggggatggcccctggaagtccctagctggctctgggcatgggaggtggggtaccgccttacccttatctcccaagttcatggaaaccaggtaactcagataatccccttctccactgagggggagactaaggcccagagaagccccagccttcctcctagggatctgatacgaggaagacacagctggaatctggattccactcagctcctgggatactgtcccctgcttcccccaccccttcaccctgcaggtcccctgcctgtgcccttcaccaatggggagatacagaaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaacgaaaacatacagaaaacactgagaagccagatgacaagaccaggagacagacagggcgaaacagaatacaacccagcaattacactcacggaagaa

SEQ ID NO: 322389 - DNA, 2651 bp, Homo sapiens
  misc_feature (39)..(39): n is a, c, g, or t
  misc_feature (2651)..(2651): n is a, c, g, or t
cggcttagcgctccgtaggccccctgggggttaatcggncgagcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtcccctgcctgtgcccttcaccaatggggagatacagaaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaaaaaaaaaaaaaaaaaaaaaaaaaaaaaaaaaaaaaaaaaaaaaaaaaaaaaaaaaaaaaaaaaaaaaaaaaaaaaagaaggagggggcgcggagcgagcagagacactatctctcctcaaggagggggcgcgcccaacataactaacgagcacacacccgcgattagttagtagaaagagggcggcgcactcaaaaaaggggagagactatattaataagacgcacaggcagcagcgggcggacgccattatcataacaacaccgcgaaaggagagagggaggaacaagagggaagagaacggagggaaacactcagtgagaaggaagaacacccacaactaacatccgcggggtgaggaccaaaaatacaggcgaaggaaaaaacaagctacagcccaaacgaaaataaagaaccgcacagagaaaaggaacagaacacaaacgagaacgagcgaagcagagcaaagagcggggagagcaaaaaaaaaacgagacgggcgacagacgcaggcccgacgcgggagcggcacaaagagtaagagcgacaaaccggaagggaccgaacgagaaatcaacgaaacaaaaatcttgcaaacaccgagcgaacaaaaaaggcagacaagaagggn

SEQ ID NO: 322390 - DNA, 2651 bp, Homo sapiens
  misc_feature (2651)..(2651): n is a, c, g, or t
ctattggcccgcggaggtccccaccctcagcgcggccccgcccccggggtaaggagccggggcggactctgggacgctcagacgccgcgcggggcggggcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtcccctgcctgtgcccttcaccaatggggagatacagaaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaaaaaaaaaaaaaaaaaaaaaaaaaaaaaaaaaaaaaaaaaaaaaaaaaaaaaaaaaaaaaaaaaaaaaaaaaaaaaagaaggagggggcgcggagcgagcagagacactatctctcctcaaggagggggcgcgcccaacataactaacgagcacacacccgcgattagttagtagaaagagggcggcgcactcaaaaaaggggagagactatattaataagacgcacaggcagcagcgggcggacgccattatcataacaacaccgcgaaaggagagagggaggaacaagagggaagagaacggagggaaacactcagtgagaaggaagaacacccacaactaacatccgcggggtgaggaccaaaaatacaggcgaaggaaaaaacaagctacagcccaaacgaaaataaagaaccgcacagagaaaaggaacagaacacaaacgagaacgagcgaagcagagcaaagagcggggagagcaaaaaaaaaacgagacgggcgacagacgcaggcccgacgcgggagcggcacaaagagtaagagcgacaaaccggaagggaccgaacgagaaatcaacgaaacaaaaatcttgcaaacaccgagcgaacaaaaaaggcagacaagaagggn

SEQ ID NO: 322391 - DNA, 2350 bp, Homo sapiens
  misc_feature (2350)..(2350): n is a, c, g, or t
ctattggcccgcggaggtccccaccctcagcgcggccccgcccccggggtaaggagccggggcggactctgggacgctcagacgccgcgcggggcggggcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaaaaaaaaaaaaaaaaaaaaaaaaaaaaaaaaaaaaaaaaaaaaaaaaaaaaaaaaaaaaaaaaaaaaaaaaaaaaaagaaggagggggcgcggagcgagcagagacactatctctcctcaaggagggggcgcgcccaacataactaacgagcacacacccgcgattagttagtagaaagagggcggcgcactcaaaaaaggggagagactatattaataagacgcacaggcagcagcgggcggacgccattatcataacaacaccgcgaaaggagagagggaggaacaagagggaagagaacggagggaaacactcagtgagaaggaagaacacccacaactaacatccgcggggtgaggaccaaaaatacaggcgaaggaaaaaacaagctacagcccaaacgaaaataaagaaccgcacagagaaaaggaacagaacacaaacgagaacgagcgaagcagagcaaagagcggggagagcaaaaaaaaaacgagacgggcgacagacgcaggcccgacgcgggagcggcacaaagagtaagagcgacaaaccggaagggaccgaacgagaaatcaacgaaacaaaaatcttgcaaacaccgagcgaacaaaaaaggcagacaagaagggn

SEQ ID NO: 322392 - DNA, 1017 bp, Homo sapiens
  misc_feature (910)..(910): n is a, c, g, or t
ctattggcccgcggaggtccccaccctcagcgcggccccgcccccggggtaaggagccggggcggactctgggacgctcagacgccgcgcggggcggggcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgnacggggtctgcttggcggggcccccctgcggcccgtgggtcccgccaccggcggcgggccggcaccagcgcgtgtgtggcgcggcacccgcattcttccaacgtctg

SEQ ID NO: 322393 - DNA, 1346 bp, Homo sapiens
atgttagcaacatacttgggctcaggaaataattgctagtgattgtatttgattagttttttggccattgtacaaagttagttttgagatgggtcactgcgatgtcacggatctcgaggagtctgtgattacaccacgtccatgtcaagcacatagctatgtgttgttgatgttgtccagtagctgtctagatataattgacgggtttctcttgtattcttgagtgagcagagctgaggttttagagcaccacaaaactgtaggaatggagtatcaaaaggttgaatacctgcctcatgaggaaactgggggaaagatgacagggcagattgtggcagaatgtatgtactgaaaatttgggggaggaactatagcaggaagaaaatacataaccagggacaccaaacagttggattttttgtttagtggttgttgatttggcttcaatttagggaatattttgagggtttttattgcttcagtagtttcaaactattttgtgtctatgtaagttggcttttattctcctgatctctcaaactcaaatctcaaaatattgaaaacttctgttatttttccctaaccctaatttaccttcctcaaaatctaatgaattatcaaatcctattgcatcttccttggaatcatcattagttaaactaaaggcaataggaagtgagtttaaaatcctttcttccagagcctgcaggtctgttcatgtgtttataattttcgttttttgtttttttttccatggattcagtggtctcctactggtttattcatgtttggccttgcgcttctcaaattcctttttatacctcatcagcaagtgaacttattccactgccctcatggctagctgtggcctgtgaaatcgtccagattccttgggcagacactcagggtgctttgtatttttgttcggggctgtgttttcagccttactgcttgccgttcccatatgtggactcttgcctgtcgcactgatttctgtcttcccaatccaatgctcatagagatcactaaggataatcctgcttattaagtgatgagttggtttgaattgtctctggtggtagtctaggaaagtgggatttctttttaattttggggttttgtttttgatttgtggtaccaatgaggattttatttgagacagtgtaatgggggccagatgagagaaccattttctttgtaagcttagcatggctgggctctagccagctccagatgaaattttggctaattatccctttagaaaagtcaggcttaagcagaactgggctctaggtcaattaaccaaaagccagttcacccaatgaccagttcatttatttaaaaaa

SEQ ID NO: 322394 - DNA, 592 bp, Homo sapiens
aatcccacccggggcggcttgggcatttatccgggcgtcagttcctctggctcctgggtttggggaatgagacggtctctgctgacaggcgccctgcagctccctgctactaactgacccctgtggactcccagtcaccaggtgagacccacacgggtcatcctacagacaaggctggcacaaagctccaaatctaggctatgatactatttttgggttccatatgctgcccccaacaaaaacaaaaataaagaccaagccccagaatccatttgtgagagagggcactgttggggtctgtgggcggggctgggaggagcctctatcacaactgtaggtctggaaaaacagtaaggacctttccccctcgtgatacaaatcacaagaagcaaagctttttcagaacaggcagaagattgcttttattctctgtgtactgctgatttgctgtgatttatagtgagaagggaaagagagagaaatttcctccaagagttcctatcagactggggagggagaaaatgaatttttatgtttatccaaagtggcatagtttttcagaaagtctgcttattttgatgtaaatgttcca

SEQ ID NO: 322395 - DNA, 451 bp, Homo sapiens
gccgctctctgcctaccaccattccatatttaagtggaatggtggtaggcagagaggcggtggcccagcaatccttaagtccagattaccagcattccatatttaagtggagcccctacgtagaaaggccccggggctttattttagtctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttcccaaaaaaaaaaa

SEQ ID NO: 322396 - DNA, 3491 bp, Homo sapiens
ggacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgactacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccgggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgcaaacacacactaattcctggcagggcccccagcccctcccctggctgagcagccctgtggctgaaatgactagcagataaacagacccccttctgctccgcttcctcctgcccagccaggcaacaccctcaaccggctccatcacatcctcaggtctcgggaccatggggggctcagaggggagacacacctactgcttcctcagatgggcccctccgcagccccttcccttgctcggggaaagcccccaattctgcccacacccatttatttccttccttccttccttcttttctttccttccttccttcttttttgtttttgcccccaattctgcccatacccatttctttctttccttccttccttcttttttgtttttgcccccagttctgtccacaccccttccctttcctgtcctgtcctttctttctttcttttttgatagaatcttgctctgtcgcccaggctggagtgcagtggtgagatctcagctcactgcaacctccacctcctgggttgaagtgattctcgtgcctcagcctcctgagtagctgggactgcaggcacgcgccaccacgcccagctaatttttgtatttgagtagagacggggtttcaccatgttggccaggctggtctcgaactccgcatctcaggtgatctgctcgcctcggcctcccaaagtgatgggattacaggcatgagccaccgtgcccggcttcacacccatttctttaaaaaggatcccgtagcaggcagaaaagccccttccatcctgctcctctgatactgtgcccccttggagatatttccgtcctccacccacgtgtctgtggctggaactgcccagcctgctcctggccccctggaagcctccccacagctggtaatctggacttaaggattgctgggccaccgcctctctgcctaccaccattccatatttaagtggagcccctacgtagaaaggccccggggctttattttagtctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttcccaaaaaaaaaaa

SEQ ID NO: 322397 - DNA, 3187 bp, Homo sapiens
ggacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccgggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgcaaacacacactaattcctggcagggcccccagcccctcccctggctgagcagccctgtggctgaaatgactagcagataaacagacccccttctgctccgcttcctcctgcccagccaggcaacaccctcaaccggctccatcacatcctcaggtctcgggaccatggggggctcagaggggagacacacctactgcttcctcagatgggcccctccgcagccccttcccttgctcggggaaagcccccaattctgcccacacccatttatttccttccttccttccttcttttctttccttccttccttcttttttgtttttgcccccaattctgcccatacccatttctttctttccttccttccttcttttttgtttttgcccccagttctgtccacaccccttccctttcctgtcctgtcctttctttctttcttttttgatagaatcttgctctgtcgcccaggctggagtgcagtggtgagatctcagctcactgcaacctccacctcctgggttgaagtgattctcgtgcctcagcctcctgagtagctgggactgcaggcacgcgccaccacgcccagctaatttttgtatttgagtagagacggggtttcaccatgttggccaggctggtctcgaactccgcatctcaggtgatctgctcgcctcggcctcccaaagtgatgggattacaggcatgagccaccgtgcccggcttcacacccatttctttaaaaaggatcccgtagcaggcagaaaagccccttccatcctgctcctctgatactgtgcccccttggagatatttccgtcctccacccacgtgtctgtggctggaactgcccagcctgctcctggccccctggaagcctccccacagctggtaatctgtcacacgcctgagccacggagcccggagaacccgagctacgtggagctcttggcggggatgaggagtgttgcagg

SEQ ID NO: 322398 - DNA, 2479 bp, Homo sapiens
ggacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccgggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgcaaacacacactaattcctggcagggcccccagcccctcccctggctgagcagccctgtggctgaaatgactagcagataaacagacccccttctgctccgcttcctcctgcccagccaggcaacaccctcaaccggctccatcacatcctcaggtctcgggaccatggggggctcagaggggagacacacctactgcttcctctgaacggaacagtgtccccacagagcgaataaagccaaggcttcttcccaaaaaaaaaaa

SEQ ID NO: 322399 - DNA, 868 bp, Homo sapiens
atggaatataacatgtaaaaagcggctggtcggtcgaatccgggattgcgaccagctcgacgatctaacgccgtatttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttcccaaaaaaaaaaa

SEQ ID NO: 322400 - DNA, 1255 bp, Homo sapiens
ggacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgaatggagtctctctctatcacccaggctggagagcagtggcatgatctcggctcactgcaacctctgcctcccaggttaaagtgattcttgtgcctcagctttccgagtagctgggactccaggcaggtgccaccacacctggctaatttttgtatttttagtagagatgggttctcac

SEQ ID NO: 322401 - DNA, 3511 bp, Homo sapiens
ggacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccgggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgcaaacacacactaattcctggcagggcccccagcccctcccctggctgagcagccctgtggctgaaatgactagcagataaacagacccccttctgctccgcttcctcctgcccagccaggcaacaccctcaaccggctccatcacatcctcaggtctcgggaccatggggggctcagaggggagacacacctactgcttcctcagatgggcccctccgcagccccttcccttgctcggggaaagcccccaattctgcccacacccatttatttccttccttccttccttcttttctttccttccttccttcttttttgtttttgcccccaattctgcccatacccatttctttctttccttccttccttcttttttgtttttgcccccagttctgtccacaccccttccctttcctgtcctgtcctttctttctttcttttttgatagaatcttgctctgtcgcccaggctggagtgcagtggtgagatctcagctcactgcaacctccacctcctgggttgaagtgattctcgtgcctcagcctcctgagtagctgggactgcaggcacgcgccaccacgcccagctaatttttgtatttgagtagagacggggtttcaccatgttggccaggctggtctcgaactccgcatctcaggtgatctgctcgcctcggcctcccaaagtgatgggattacaggcatgagccaccgtgcccggcttcacacccatttctttaaaaaggatcccgtagcaggcagaaaagccccttccatcctgctcctctgatactgtgcccccttggagatatttccgtcctccacccacgtgtctgtggctggaactgcccagcctgctcctggccccctggaagcctccccacagctggtaatctggacttaaggattgctgggccaccgcctctctgcctaccaccattccatatttaagtggagcccctacgtagaaaggccccggggctttattttagtctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttcccaaaaaaaaaaa

SEQ ID NO: 322402 - DNA, 3261 bp, Homo sapiens
ctacctgtctgaggaacccgagccctacctggcagctctacctgcactcggagccccggcccaatgcagcgcaactgctcggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccgggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgcaaacacacactaattcctggcagggcccccagcccctcccctggctgagcagccctgtggctgaaatgactagcagataaacagacccccttctgctccgcttcctcctgcccagccaggcaacaccctcaaccggctccatcacatcctcaggtctcgggaccatggggggctcagaggggagacacacctactgcttcctcagatgggcccctccgcagccccttcccttgctcggggaaagcccccaattctgcccacacccatttatttccttccttccttccttcttttctttccttccttccttcttttttgtttttgcccccaattctgcccatacccatttctttctttccttccttccttcttttttgtttttgcccccagttctgtccacaccccttccctttcctgtcctgtcctttctttctttcttttttgatagaatcttgctctgtcgcccaggctggagtgcagtggtgagatctcagctcactgcaacctccacctcctgggttgaagtgattctcgtgcctcagcctcctgagtagctgggactgcaggcacgcgccaccacgcccagctaatttttgtatttgagtagagacggggtttcaccatgttggccaggctggtctcgaactccgcatctcaggtgatctgctcgcctcggcctcccaaagtgatgggattacaggcatgagccaccgtgcccggcttcacacccatttctttaaaaaggatcccgtagcaggcagaaaagccccttccatcctgctcctctgatactgtgcccccttggagatatttccgtcctccacccacgtgtctgtggctggaactgcccagcctgctcctggccccctggaagcctccccacagctggtaatctggacttaaggattgctgggccaccgcctctctgcctaccaccattccatatttaagtggagcccctacgtagaaaggccccggggctttattttagtctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttcccaaaaaaaaaaa

SEQ ID NO: 322403 - DNA, 2938 bp, Homo sapiens
ggacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccgggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagcacgcgccaccacgcccagctaatttttgtatttgagtagagacggggtttcaccatgttggccaggctggtctcgaactccgcatctcaggtgatctgctcgcctcggcctcccaaagtgatgggattacaggcatgagccaccgtgcccggcttcacacccatttctttaaaaaggatcccgtagcaggcagaaaagccccttccatcctgctcctctgatactgtgcccccttggagatatttccgtcctccacccacgtgtctgtggctggaactgcccagcctgctcctggccccctggaagcctccccacagctggtaatctggacttaaggattgctgggccaccgcctctctgcctaccaccattccatatttaagtggagcccctacgtagaaaggccccggggctttattttagtctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttcccaaaaaaaaaaa

SEQ ID NO: 322404 - DNA, 1969 bp, Homo sapiens
ggacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttcccaaaaaaaaaaa

SEQ ID NO: 322405 - DNA, 212 bp, Homo sapiens
tcgagtttaatcaacatgcatcctaattaaggggaaatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactatt

SEQ ID NO: 322406 - DNA, 423 bp, Homo sapiens
  misc_feature (421)..(421): n is a, c, g, or t
acaaagacttgggaatcactcactccgaggatgaagaatgggttaaatggctgaggagacagtcaaaggaatagagaggcctggctttgagggcctcttcaccaccagaacccaaaacgtttaccatacaaagaaaaaaacacatcatagaagaagctggagaaagttatgtaaagtgaaataagtcaagcacagaaaaacaaatacctcatgatctcactcatatgtggaatctaaaatgattgaactcatagaaacagagaacaaaatagtggttaccaggggctggggagtgatggaataaggagatgacagtcaaagactacaaagttgcagatagagaggaggattaatgataagcatttatgatgatgggtatgttaattggcttgattcaacccttccaccttgtacagatatnat

SEQ ID NO: 322407 - DNA, 5135 bp, Homo sapiens
cccgtctctactaaaaatacaaaaagtagccgggtgtggtggtgcactcctgtaatctcagctactcaggaagctcaggcaggggaattgcttgaacccaggaggcagaggttgcagtgagctgagatcacgccactgcactccagcctgggtgatggagtgagactttgtctcaaaaaaaatatatatatataaactctttgaaaattacaaaagtagtctgaaaataccatcaccttaaagatagttagttgtttcctaccaaatgtctaccaagtttgctattccttgtgctttaattttacattgttttttcaaaaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaactcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacccgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcgcccagctatactgtatattttaagaagttccagcatgttgcatctctgcatttatcctatatcattaaaagaacataagttatcatggtgttgggtaaattagcgaaatcaacccttcctaagtttaagggaaaagttatttttaaaaacaacttaataaaaacttacactcttttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactatt

SEQ ID NO: 322408 - DNA, 4553 bp, Homo sapiens
cccgtctctactaaaaatacaaaaagtagccgggtgtggtggtgcactcctgtaatctcagctactcaggaagctcaggcaggggaattgcttgaacccaggaggcagaggttgcagtgagctgagatcacgccactgcactccagcctgggtgatggagtgagactttgtctcaaaaaaaatatatatatataaactctttgaaaattacaaaagtagtctgaaaataccatcaccttaaagatagttagttgtttcctaccaaatgtctaccaagtttgctattccttgtgctttaattttacattgttttttcaaaaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaaccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaactcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacccgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcgcccagctatactgtatattttaagaagttccagcatgttgcatctctgcatttatcctatatcattaaaagaacataagttatcatggtgttgggtaaattagcgaaatcaacccttcctaagtttaagggaaaagttatttttaaaaacaacttaataaaaacttacactcttttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactatt

SEQ ID NO: 322409 - DNA, 5084 bp, Homo sapiens
cccgtctctactaaaaatacaaaaagtagccgggtgtggtggtgcactcctgtaatctcagctactcaggaagctcaggcaggggaattgcttgaacccaggaggcagaggttgcagtgagctgagatcacgccactgcactccagcctgggtgatggagtgagactttgtctcaaaaaaaatatatatatataaactctttgaaaattacaaaagtagtctgaaaataccatcaccttaaagatagttagttgtttcctaccaaatgtctaccaagtttgctattccttgtgctttaattttacattgttttttcaaaaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaatggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacccgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcgcccagctatactgtatattttaagaagttccagcatgttgcatctctgcatttatcctatatcattaaaagaacataagttatcatggtgttgggtaaattagcgaaatcaacccttcctaagtttaagggaaaagttatttttaaaaacaacttaataaaaacttacactcttttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactatt

SEQ ID NO: 322410 - DNA, 3078 bp, Homo sapiens
cccgtctctactaaaaatacaaaaagtagccgggtgtggtggtgcactcctgtaatctcagctactcaggaagctcaggcaggggaattgcttgaacccaggaggcagaggttgcagtgagctgagatcacgccactgcactccagcctgggtgatggagtgagactttgtctcaaaaaaaatatatatatataaactctttgaaaattacaaaagtagtctgaaaataccatcaccttaaagatagttagttgtttcctaccaaatgtctaccaagtttgctattccttgtgctttaattttacattgttttttcaaaaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggcgtgagccactgcgcccagctatactgtatattttaagaagttccagcatgttgcatctctgcatttatcctatatcattaaaagaacataagttatcatggtgttgggtaaattagcgaaatcaacccttcctaagtttaagggaaaagttatttttaaaaacaacttaataaaaacttacactcttttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactatt

SEQ ID NO: 322411 - DNA, 442 bp, Homo sapiens
accctgcaaacagacctcagctccgcggaagttgcggtaagtggagctttgtgctcctggtttccccttgagaggcggcagcggggccctgggaaggttggtgggtaacattcaaagccctgtagtgggttccgccctccaggagcctggagcagatgacgagaaggggagctagtgggagaaattaagcagtccatgaaatccttgggtatcatctgagctaaggtatgtgaaagaggtttgcagtcgataacgtgccatttaaagttgtttttacggtgggaatttcttgaggactgaaaccttgaatgctcgctcttgcattcctcacaatttctggctcacactctgctacgtagtaagggatcagttaatgtttgaagttcatggactactggaagtaaagtgtaaacagcaaagtgcgagaatgctatgcgtgtga

SEQ ID NO: 322412 - DNA, 249 bp, Homo sapiens
aagcgtgagccaccgcccctgacatgagccattgacttttaaagcaggagaataatttggatcagatttatatggaaacactcttctagcagcattatggggacttttccataagtctggtgagttgatgaagttagcaactaaggtggtgggtatggaaagataatttatatggaagaaggggtgaggatgatttgaacgtttctattgtacacgataatgactttacctgagaatatgttttgctag

SEQ ID NO: 322413 - DNA, 5221 bp, Homo sapiens
ttcccgcgaccccaacgtcccagaggcggggccggagtcggcggtggcgctccttggagccggctcccgctcctaccctgcaaacagacctcagctccgcggaagttgcgagacggggtttcaccatgttggtcgggctggtctggaaatcctgacttcaggtgatccacccgcctcggcctcccaaaatgctgggattacaagcgtgagccaccgcccctgacatgagccattgacttttaaagcaggagaataatttggatcagatttatatggaaacactcttctagcagcattatggggacttttccataagtctggatactgaggatttggaattaaagaaatcattcaccagacatcatggagcctatatatccttttgcacggccccagatgaataccaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaactcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacccgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcgcccagctatactgtatattttaagaagttccagcatgttgcatctctgcatttatcctatatcattaaaagaacataagttatcatggtgttgggtaaattagcgaaatcaacccttcctaagtttaagggaaaagttatttttaaaaacaacttaataaaaacttacactcttttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactatt

SEQ ID NO: 322414 - DNA, 1106 bp, Homo sapiens
cccgtctctactaaaaatacaaaaagtagccgggtgtggtggtgcactcctgtaatctcagctactcaggaagctcaggcaggggaattgcttgaacccaggaggcagaggttgcagtgagctgagatcacgccactgcactccagcctgggtgatggagtgagactttgtctcaaaaaaaatatatatatataaactctttgaaaattacaaaagtagtctgaaaataccatcaccttaaagatagttagttgtttcctaccaaatgtctaccaagtttgctattccttgtgctttaattttacattgttttttcaaaaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaagcagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatgggtaagtaaaagatacattaatctaaatgttagttgcattagtatattttcagaatgtccatgtaatgtgaaagaattgtccagtcaatttatatgccagagatatggtggcttggttaataaccaggg

SEQ ID NO: 322415 - DNA, 274 bp, Homo sapiens
accctgcagcccatagtagccttcatggtgcctatgcccgcagccagtcacccatggctcccaacattctcttcaccctttgcccttcgcccaggccacctgtactaatctccacacctgcctcagacctgcttttactgctgtctccactaccatcccccagcagggtgtgagactggtgcaaaggggacctacctcaggtggcctggccagcgtagctacaaagcacctagagcacctgaggctgctgcacatctacctccctagtccggaa

SEQ ID NO: 322416 - DNA, 1342 bp, Homo sapiens
  misc_feature (7)..(7): n is a, c, g, or t
  misc_feature (151)..(151): n is a, c, g, or t
  misc_feature (176)..(176): n is a, c, g, or t
  misc_feature (185)..(185): n is a, c, g, or t
  misc_feature (192)..(192): n is a, c, g, or t
  misc_feature (215)..(215): n is a, c, g, or t
  misc_feature (234)..(234): n is a, c, g, or t
  misc_feature (282)..(283): n is a, c, g, or t
  misc_feature (291)..(291): n is a, c, g, or t
  misc_feature (298)..(301): n is a, c, g, or t
  misc_feature (361)..(362): n is a, c, g, or t
  misc_feature (364)..(365): n is a, c, g, or t
gtgattncaaccattttgaccttgcaggggatcccctgaatgatgtcctaaatgttggaacatgtacctttgttcccctgatgcattgatgaaaatgattgtcctctatgagattgtgattatgctttgttgtccatggtccgcaaccttnctttgggtccttattgcctaccctncgcattgancgtgcanatgaagcatttgcttgcatgctnccattgagccttgagctancttgtgtgctgctccctttaaagagcctttgcctgctgcgattgtgcnngcatgcantttgtannnnagcatgcttggcatcacatcacattacagctgaaagctgcgatgcagtttactgcctttnngnnggcgcgaggtatcatttatcactgtgatcttaccaaagaggagctggagccaagagttttccgagaggtgaccgtaaaaggaattgatgcttctgattaccagacagtccagctccccaagggtactgagtcttccagaaactgaatcactggttgattgatgatgacgaagaatgtctctgttcctttgcaatgagaggtcaccaatagggcaccaggtgtttatcaaggcccctcccacctggagggctggaccacacaggccacagattaggaatcagaacattgtttgtgaaggaagatgagaataaagagcgctggatgttccccacaatgtttctgtgaaactagggcattattatagcttggtgaattacccttcaattgtctagaaatggtctagatgataggctacatctagatcatgaataaagctttgtttactaaaacaggtggtgggctggatttggtgtagagctatgatttatcagcccctgttctacatcagcagttggcaaactggcctcctgttttattggagaacacatgcccatttgtttacatattgcctgtggttgctttggcacttagagtggttgcaacagaaactctatgtcccagaaggcctgaaatatttaatatatggcctttaagaaaaagtttgcagaatcttcatctatgtaaatagcatttaaaagtacaacattcttgatagacatacagggccgagaagacatacagggtcaagaagctctgtcagacaggcctgaaatccacgtggggcaagtcatttaacctttctgccacagttttttcaactgtaaagtagagattgatagtatctgttttttaggattcctgtgggattattaagagataaggtatattcaagatctggcaatagaatataatgtatttttttcaatcaacgttagaaataaatgtaacagacttttagtttcctatttatttggctg

SEQ ID NO: 322417 - DNA, 2928 bp, Homo sapiens
cccggcctcgcagacagcggcttcctgctttctgcacgtcctcgccgccgcgccgccagtccgtttgtgctagctctggccgtgagccggccgcccgctgccgccggccgccccgcagctgcctgcgccccagccgcgcctcgcggccagcccggctagctcaggtccgctcccggagcccgcgcccctccacgctgccccctgcctgtccccggccatgctgtcccttcagtaccccgacgtgtaccgcgacgagaccgccgtacaggattatcatggtcataaaatttgtgacccttacgcctggcttgaagaccccgacagtgaacagactaaggcctttgtggaggcccagaataagattactgtgccatttcttgagcagtgtcccatcagaggtttatacaaagagagaatgactgaactatatgattatcccaagtatagttgccacttcaagaaaggaaaacggtatttttatttttacaatacaggtttgcagaaccagcgagtattatatgtacaggattccttagagggtgaggccagagtgttcctggaccccaacatactgtctgacgatggcacagtggcactccgaggttatgcgttcagcgaagatggtgaatattttgcctatggtctgagtgccagtggctcagactgggtgacaatcaagttcatgaaagttgatggtgccaaagagcttccagatgtgcttgaaagagtcaagttcagctgtatggcctggacccatgatgggaagggaatgttctacaactcataccctcaacaggatggaaaaagtgatggcacagagacatctaccaatctccaccaaaagctctactaccatgtcttgggaaccgatcagtcagaagatattttgtgtgctgagtttcctgatgaacctaaatggatgggtggagctgagttatctgatgatggccgctatgtcttgttatcaataagggaaggatgtgatccagtaaaccgactctggtactgtgacctacagcaggaatccagtggcatcgcgggaatcctgaagtgggtaaaactgattgacaactttgaaggggaatatgactacgtgaccaatgaggggacggtgttcacattcaagacgaatcgccagtctcccaactatcgcgtgatcaacattgacttcagggatcctgaagagtctaagtggaaagtacttgttcctgagcatgagaaagatgtcttagaatggatagcttgtgtcaggtccaacttcttggtcttatgctacctccatgacgtcaagaacattctgcagctccatgacctgactactggtgctctccttaagaccttcccgctcgatgtcggcagcattgtagggtacagcggtcagaagaaggacactgaaatcttctatcagtttacttcctttttatctccaggtatcatttatcactgtgatcttaccaaagaggagctggagccaagagttttccgagaggtgaccgtaaaaggaattgatgcttctgattaccagacagtccagattttctaccctagcaaggatggtacgaagattccaatgttcattgtgcataaaaaaggcataaaattggatggctctcatccagctttcttatatggctatggcggcttcaacatatccatcacacccaactacagtgtttccaggcttatttttgtgagacacatgggtggtatcctggcagtggccaacatcagaggaggtggcgaatatggagagacgtggcataaaggtggtatcttggccaacaaacaaaactgctttgatgactttcagtgtgctgctgagtatctgatcaaggaaggttacacatctcccaagaggctgactattaatggaggttcaaatggaggcctcttagtggctgcttgtgcaaatcagagacctgacctctttggttgtgttattgcccaagttggagtaatggacatgctgaagtttcataaatataccatcggccatgcttggaccactgattatgggtgctcggacagcaaacaacactttgaatggcttgtcaaatactctccattgcataatgtgaagttaccagaagcagatgacatccagtacccgtccatgctgctcctcactgctgaccatgatgaccgcgtggtcccgcttcactccctgaagttcattgccacccttcagtacatcgtgggccgcagcaggaagcaaagcaaccccctgcttatccacgtggacaccaaggcgggccacggggcggggaagcccacagccaaagtgatagaggaagtctcagacatgtttgcgttcatcgcgcggtgcctgaacgtcgactggattccataaacagttttcgtgcttcctcctgacagcgacagaaaacctcaagggctttcccacgttgacaccaagaaaccactgggcataatgcttccccacgggaacattattcctgcactcacaggctacagttgaacagaactgccgtgggaattttatcttttttaggcttctcctttttagcaaggccttggtgtttctttttccaccctgtctaggcacatgtggttttttggtgttttttttaagggcatgttgggataaatagctaaatggcaacaaacacattgtgaatattagattgctgaattaaggatcatagtcgggcatacttatctatatccataacctctatatctttaaataaatgtgagaactgttctcatggagaagacttctttgcaacaataataaatgttatttaagaatgacagggatttacttccggtttcttcatattgaggggcaactccagaagtggagttttctgtgagaataaagcatttcacctttctgcaacaagttagttttcaagcagttaagtcatagaatgtttgttagctgtgaaaataagttgttcatcc

SEQ ID NO: 322418 - DNA, 2826 bp, Homo sapiens
cccggcctcgcagacagcggcttcctgctttctgcacgtcctcgccgccgcgccgccagtccgtttgtgctagctctggccgtgagccggccgcccgctgccgccggccgccccgcagctgcctgcgccccagccgcgcctcgcggccagcccggctagctcaggtccgctcccggagcccgcgcccctccacgctgccccctgcctgtccccggccatgctgtcccttcagtaccccgacgtgtaccgcgacgagaccgccgtacaggattatcatggtcataaaatttgtgacccttacgcctggcttgaagaccccgacagtgaacagactaaggcctttgtggaggcccagaataagattactgtgccatttcttgagcagtgtcccatcagaggtttatacaaagagagaatgactgaactatatgattatcccaagtatagttgccacttcaagaaaggaaaacggtatttttatttttacaatacaggtttgcagaaccagcgagtattatatgtacaggattccttagagggtgaggccagagtgttcctggaccccaacatactgtctgacgatggcacagtggcactccgaggttatgcgttcagcgaagatggtgaatattttgcctatggtctgagtgccagtggctcagactgggtgacaatcaagttcatgaaagttgatggtgccaaagagcttccagatgtgcttgaaagagtcaagttcagctgtatggcctggacccatgatgggaagggaatgttctacaactcataccctcaacaggatggaaaaagtgatggcacagagacatctaccaatctccaccaaaagctctactaccatgtcttgggaaccgatcagtcagaagatattttgtgtgctgagtttcctgatgaacctaaatggatgggtggagctgagttatctgatgatggccgctatgtcttgttatcaataagggaaggatgtgatccagtaaaccgactctggtactgtgacctacagcaggaatccagtggcatcgcgggaatcctgaagtgggtaaaactgattgacaactttgaaggggaatatgactacgtgaccaatgaggggacggtgttcacattcaagacgaatcgccagtctcccaactatcgcgtgatcaacattgacttcagggatcctgaagagtctaagtggaaagtacttgttcctgagcatgagaaagatgtcttagaatggatagcttgtgtcaggtccaacttcttggtcttatgctacctccatgacgtcaagaacattctgcagctccatgacctgactactggtgctctccttaagaccttcccgctcgatgtcggcagcattgtagggtacagcggtcagaagaaggacactgaaatcttctatcagtttacttcctttttatctccaggtatcatttatcactgtgatcttaccaaagaggagctggagccaagagttttccgagaggtgaccgtaaaaggaattgatgcttctgattaccagacagtccagattttctaccctagcaaggatggtacgaagattccaatgttcattgtgcataaaaaaggcataaaattggatggctctcatccagctttcttatatggctatggcggcttcaacatatccatcacacccaactacagtgtttccaggcttatttttgtgagacacatgggtggtatcctggcagtggccaacatcagaggaggtggcgaatatggagagacgtggcataaaggtggtatcttggccaacaaacaaaactgctttgatgactttcagtgtgctgctgagtatctgatcaaggaaggttacacatctcccaagaggctgactattaatggaggttcaaatggaggcctcttagtggctgcttgtgcaaatcagagacctgacctctttggttgtgttattgcccaagttggagtaatggacatgctgaagtttcataaatataccatcggccatgcttggaccactgattatgggtgctcggacagcaaacaacactttgaatggcttgtcaaatactctccattgcataatgtgaagttaccagaagcagatgacatccagtacccgtccatgctgctcctcactgctgaccatgatgaccgcgtggtcccgcttcactccctgaagttcattgccacccttcagtacatcgtgggccgcagcaggaagcaaagcaaccccctgcttatccacgtggacaccaaggcgggccacggggcggggaagcccacagccaaagtgatagaggaagtctcagacatgtttgcgttcatcgcgcggtgcctgaacgtcgactggattccataaacagttttcgtgcttcctcctgacagcgacagaaaacctcaagggctttcccacgttgacaccaagaaaccactgggcataatgcttccccacgggaacattattcctgcactcacaggctacagttgaacagaactgccgtgggaattttatcttttttaggcttctcctttttagcaaggccttggtgtttctttttccaccctgtctaggcacatgtggttttttggtgttttttttaagggcatgttgggataaatagctaaatggcaacaaacacattgtgaatattagattgctgaattaaggatcatagtcgggcatacttatctatatccataacctctatatctttaaataaatgtgagaactgttctcatggagaagacttctttgcaacaataataaatgttatttaagaatgaaaaaaaaattcacataccattcctctcttcaatctcttaataaataaaaaa

SEQ ID NO: 322419 - DNA, 1659 bp, Homo sapiens
atctgtcccagtgtctctcaccctatttctgcctccctaataggtgatggtagacaattaataggattagcaggccatctagaaacacaactgtgatcattgtttagatttgctctgcctagagaaggcttggcagaaaagagttgggggtaatcttttcctgcttttcttaaacccccggggcaacattttagtttgccagcaaaactcaactgtttttggctttctgccatactgttttagaacaaaaggagaggagagacaataggagcttcgtgtgggctgtccacctgctacacagatttcttccctcccctcccctccacttgctttgcctggagttacactgatggtcgacgggtgatggattttctaccctagcaaggatggtacgaagattccaatgttcattgtgcataaaaaaggcataaaattggatggctctcatccagctttcttatatggctatggcggcttcaacatatccatcacacccaactacagtgtttccaggcttatttttgtgagacacatgggtggtatcctggcagtggccaacatcagaggaggtggcgaatatggagagacgtggcataaaggtggtatcttggccaacaaacaaaactgctttgatgactttcagtgtgctgctgagtatctgatcaaggaaggttacacatctcccaagaggctgactattaatggaggttcaaatggaggcctcttagtggctgcttgtgcaaatcagagacctgacctctttggttgtgttattgcccaagttggagtaatggacatgctgaagtttcataaatataccatcggccatgcttggaccactgattatgggtgctcggacagcaaacaacactttgaatggcttgtcaaatactctccattgcataatgtgaagttaccagaagcagatgacatccagtacccgtccatgctgctcctcactgctgaccatgatgaccgcgtggtcccgcttcactccctgaagttcattgccacccttcagtacatcgtgggccgcagcaggaagcaaagcaaccccctgcttatccacgtggacaccaaggcgggccacggggcggggaagcccacagccaaagtgatagaggaagtctcagacatgtttgcgttcatcgcgcggtgcctgaacgtcgactggattccataaacagttttcgtgcttcctcctgacagcgacagaaaacctcaagggctttcccacgttgacaccaagaaaccactgggcataatgcttccccacgggaacattattcctgcactcacaggctacagttgaacagaactgccgtgggaattttatcttttttaggcttctcctttttagcaaggccttggtgtttctttttccaccctgtctaggcacatgtggttttttggtgttttttttaagggcatgttgggataaatagctaaatggcaacaaacacattgtgaatattagattgctgaattaaggatcatagtcgggcatacttatctatatccataacctctatatctttaaataaatgtgagaactgttctcatggagaagacttctttgcaacaataataaatgttatttaagaatgaaaaaaaaattcacataccattcctctcttcaatctcttaataaataaaaaa

SEQ ID NO: 322420 - DNA, 653 bp, Homo sapiens
  misc_feature (482)..(482): n is a, c, g, or t
  misc_feature (486)..(486): n is a, c, g, or t
  misc_feature (490)..(490): n is a, c, g, or t
  misc_feature (560)..(560): n is a, c, g, or t
  misc_feature (605)..(605): n is a, c, g, or t
cccggcctcgcagacagcggcttcctgctttctgcacgtcctcgccgccgcgccgccagtccgtttgtgctagctctggccgtgagccggccgcccgctgccgccggccgccccgcagctgcctgcgccccagccgcgcctcgcggccagcccggctagctcaggtccgctcccggagcccgcgcccctccacgctgccccctgcctgtccccggccatgctgtcccttcagtaccccgacgtgtaccgcgacgagaccgccgtacaggattatcatggtcataaaatttgtgacccttacgcctggcttgaagaccccgacagtgaacagactaaggcctttgtggaggcccagaataagattactgtgccatttcttgagcagtgtcccatcagaggtttatacaaagagagaatgactgaactatatgattatcccaagtatagttgccacttcaagaaaggaaaacgggtgatttttntatntttntaacaaataacagggtgttggcaggaacacaggcggagtgatttataatggtaacaagggatttcctctnaggagggggtggaggggccaggaggtggtttccctggggacaccncaaacaataactggttctggagcggatggggcaacaggtggggcaact

SEQ ID NO: 322421 - DNA, 525 bp, Homo sapiens
aatttgtgacccttacgcctggcttgaagaccccgacagtgaacagactaaggtaatttggtttctaattaaagataaggcagccttagtagctagcaccaaactctaaatgtcagtaactatagcttttcctttctggtgttctcctgtgttttctgccatgggatggtgagtatacctgttgttaccactactttttgtcaaataatttatgggaaaaagacaaaagcatggcttagtcccagagaagatcacctaagtgtttcagataatgtttatggttcatagtgacactgatgagctattttaaatgaaaatatcagaaagaaaactgatttttgccaaaagaaaaaatgaaaacctagatagaaatgatgttaaaggaaaaaattgcctaaatatttttttccaaagaaaaggaaatcttgtatatgaaatgaatattaggtcatgaaaactgaacactgtccttaaattgcttattgatgtcaacacaacaacagtgaaacaaaagctaagtagtga

SEQ ID NO: 322422 - DNA, 514 bp, Homo sapiens
agaatatgaaactactcaccttaagagacagtaagcatgcctgtgatttgggttgtttcaacagacctgtgagcttccttcctacagtctttcaaagttggagccacataaatgacacagctccccagtttccaggagcccttgccagtcatggcctaaatggtaacgcataggcacagtccatggtggtcactcacgtactagttaactgcagtcctcactgctaattaactacctaggtccctgtgccataaaactctactgttgctctccagcctcacaaaggtgtttttgccttccagatactctccattgcataatgtgaagttaccagaagcagatgacatccagtacccgtccatgctgctcctcactgctgaccatgatgaccgcgtggtcccgcttcactccctgaagttcattgccacccttcagtacatcgtgggccgcagcaggaagcaaagcaaccccctgcttatccacgtggacaccaaggcgggccacggggcgggga

SEQ ID NO: 322423 - DNA, 515 bp, Homo sapiens
ggcggggaagcccacagccaaagtgatagaggaagtctcagacatgtttgcgttcatcgcgcggtgcctgaacgtcgactggattccataaacagttttcgtgcttcctcctgacagcgacagaaaacctcaagggctttcccacgttgacaccaagaaaccactgggcataatgcttccccacgggaacattattcctgcactcacaggctacagttgaacagaactgccgtgggaattttatcttttttaggcttctcctttttagcaaggccttggtgtttctttttccaccctgtctaggcacatgtggttttttggtgttttttttaagggcatgttgggataaatagctaaatggcaacaaacacattgtgaatattagattgctgaattaaggatcatagtcgggcatacttatctatatccataacctctatatctttaaataaatgtgagaactgttctcatggagaagacttctttgcaacaataataaatgttatttaagaatg

SEQ ID NO: 322424 - DNA, 2763 bp, Homo sapiens
cccggcctcgcagacagcggcttcctgctttctgcacgtcctcgccgccgcgccgccagtccgtttgtgctagctctggccgtgagccggccgcccgctgccgccggccgccccgcagctgcctgcgccccagccgcgcctcgcggccagcccggctagctcaggtccgctcccggagcccgcgcccctccacgctgccccctgcctgtccccggccatgctgtcccttcagtaccccgacgtgtaccgcgacgagaccgccgtacaggattatcatggtcataaaatttgtgacccttacgcctggcttgaagaccccgacagtgaacagactaaggcctttgtggaggcccagaataagattactgtgccatttcttgagcagtgtcccatcagaggtttatacaaagagagaatgactgaactatatgattatcccaagtatagttgccacttcaagaaaggaaaacggtatttttatttttacaatacaggtttgcagaaccagcgagtattatatgtacaggattccttagagggtgaggccagagtgttcctggaccccaacatactgtctgacgatggcacagtggcactccgaggttatgcgttcagcgaagatggtgaatattttgcctatggtctgagtgccagtggctcagactgggtgacaatcaagttcatgaaagttgatggtgccaaagagcttccagatgtgcttgaaagagtcaagttcagctgtatggcctggacccatgatgggaagggaatgttctacaactcataccctcaacaggatggaaaaagtgatggcacagagacatctaccaatctccaccaaaagctctactaccatgtcttgggaaccgatcagtcagaagatattttgtgtgctgagtttcctgatgaacctaaatggatgggtggagctgagttatctgatgatggccgctatgtcttgttatcaataagggaaggatgtgatccagtaaaccgactctggtactgtgacctacagcaggaatccagtggcatcgcgggaatcctgaagtgggtaaaactgattgacaactttgaaggggaatatgactacgtgaccaatgaggggacggtgttcacattcaagacgaatcgccagtctcccaactatcgcgtgatcaacattgacttcagggatcctgaagagtctaagtggaaagtacttgttcctgagcatgagaaagatgtcttagaatggatagcttgtgtcaggtccaacttcttggtcttatgctacctccatgacgtcaagaacattctgcagctccatgacctgactactggtgctctccttaagaccttcccgctcgatgtcggcagcattgtagggtacagcggtcagaagaaggacactgaaatcttctatcagtttacttcctttttatctccaggtatcatttatcactgtgatcttaccaaagaggagctggagccaagagttttccgagaggtgaccgtaaaaggaattgatgcttctgattaccagacagtccagattttctaccctagcaaggatggtacgaagattccaatgttcattgtgcataaaaaaggcataaaattggatggctctcatccagctttcttatatggctatggcggcttcaacatatccatcacacccaactacagtgtttccaggcttatttttgtgagacacatgggtggtatcctggcagtggccaacatcagaggaggtggcgaatatggagagacgtggcataaaggtggtatcttggccaacaaacaaaactgctttgatgactttcagtgtgctgctgagtatctgatcaaggaaggttacacatctcccaagaggctgactattaatggaggttcaaatggaggcctcttagtggctgcttgtgcaaatcagagacctgacctctttggttgtgttattgcccaagttggagtaatggacatgctgaagtttcataaatataccatcggccatgcttggaccactgattatgggtgctcggacagcaaacaacactttgaatggcttgtcaaatactctccattgcataatgtgaagttaccagaagcagatgacatccagtacccgtccatgctgctcctcactgctgaccatgatgaccgcgtggtcccgcttcactccctgaagttcattgccacccttcagtacatcgtgggccgcagcaggaagcaaagcaaccccctgcttatccacgtggacaccaaggcgggccacggggcggggaagcccacagccaaagtgatagaggaagtctcagacatgtttgcgttcatcgcgcggtgcctgaacgtcgactggattccataaacagttttcgtgcttcctcctgacagcgacagaaaacctcaagggctttcccacgttgacaccaagaaaccactgggcataatgcttccccacgggaacattattcctgcactcacaggctacagttgaacagaactgccgtgggaattttatcttttttaggcttctcctttttagcaaggccttggtgtttctttttccaccctgtctaggcacatgtggttttttggtgttttttttaagggcatgttgggataaatagctaaatggcaacaaacacattgtgaatattagattgctgaattaaggatcatagtcgggcatacttatctatatccataacctctatatctttaaataatgttgtagcgaccaaccgcctcttaatcaataatataccttaaacaactaca

SEQ ID NO: 322425 - DNA, 2399 bp, Homo sapiens
cccggcctcgcagacagcggcttcctgctttctgcacgtcctcgccgccgcgccgccagtccgtttgtgctagctctggccgtgagccggccgcccgctgccgccggccgccccgcagctgcctgcgccccagccgcgcctcgcggccagcccggctagctcaggtccgctcccggagcccgcgcccctccacgctgccccctgcctgtccccggccatgctgtcccttcagtaccccgacgtgtaccgcgacgagaccgccgtacaggattatcatggtcataaaatttgtgacccttacgcctggcttgaagaccccgacagtgaacagactaaggcctttgtggaggcccagaataagattactgtgccatttcttgagcagtgtcccatcagaggtttatacaaagagagaatgactgaactatatgattatcccaagtatagttgccacttcaagaaaggaaaacggtatttttatttttacaatacaggtttgcagaaccagcgagtattatatgtacaggattccttagagggtgaggccagagtgttcctggaccccaacatactgtctgacgatggcacagtggcactccgaggttatgcgttcagcgaagatggtgaatattttgcctatggtctgagtgccagtggctcagactgggtgacaatcaagttcatgaaagttgatggtgccaaagagcttccagatgtgcttgaaagagtcaagttcagctgtatggcctggacccatgatgggaagggaatgttctacaactcataccctcaacaggatggaaaaagtgatggcacagagacatctaccaatctccaccaaaagctctactaccatgtcttgggaaccgatcagtcagaagatattttgtgtgctgagtttcctgatgaacctaaatggatgggtggagctgagttatctgatgatggccgctatgtcttgttatcaataagggaaggatgtgatccagtaaaccgactctggtactgtgacctacagcaggaatccagtggcatcgcgggaatcctgaagtgggtaaaactgattgacaactttgaaggggaatatgactacgtgaccaatgaggggacggtgttcacattcaagacgaatcgccagtctcccaactatcgcgtgatcaacattgacttcagggatcctgaagagtctaagtggaaagtacttgttcctgagcatgagaaagatgtcttagaatggatagcttgtgtcaggtccaacttcttggtcttatgctacctccatgacgtcaagaacattctgcagctccatgacctgactactggtgctctccttaagaccttcccgctcgatgtcggcagcattgtagggtacagcggtcagaagaaggacactgaaatcttctatcagtttacttcctttttatctccaggtatcatttatcactgtgatcttaccaaagaggagctggagccaagagttttccgagaggtgaccgtaaaaggaattgatgcttctgattaccagacagtccagctccccaagggtactgagtcttccagaaactgaatcactggttgattgatgatgacgaagaatgtctctgttcctttgcaatgagaggtcaccaatagggcaccaggtgtttatcaaggcccctcccacctggagggctggaccacacaggccacagattaggaatcagaacattgtttgtgaaggaagatgagaataaagagcgctggatgttccccacaatgtttctgtgaaactagggcattattatagcttggtgaattacccttcaattgtctagaaatggtctagatgataggctacatctagatcatgaataaagctttgtttactaaaacaggtggtgggctggatttggtgtagagctatgatttatcagcccctgttctacatcagcagttggcaaactggcctcctgttttattggagaacacatgcccatttgtttacatattgcctgtggttgctttggcacttagagtggttgcaacagaaactctatgtcccagaaggcctgaaatatttaatatatggcctttaagaaaaagtttgcagaatcttcatctatgtaaatagcatttaaaagtacaacattcttgatagacatacagggccgagaagacatacagggtcaagaagctctgtcagacaggcctgaaatccacgtggggcaagtcatttaacctttctgccacagttttttcaactgtaaagtagagattgatagtatctgttttttaggattcctgtgggattattaagagataaggtatattcaagatctggcaatagaatataatgtatttttttcaatcaacgttagaaataaatgtaacagacttttagtttcctatttatttggctg

SEQ ID NO: 322426 - DNA, 281 bp, Homo sapiens
tggaggaagggaggtgggtagagaagggagctgcagtgatttgcactcaagcagaccagtgtgcctgtgccggctccagatgacagagggtgctacgtggccgccgtctgcacagcaagggtgagagggcttgggagaggccagcagagaagggacagtggggtgggggagtgcatcaaactggagagaggaaggggtgagtagggctggggcaggaaggccagtgtgtggtgctgggtggcttacactcaccctcccagtcctgcggagcgagagacttt

SEQ ID NO: 322427 - DNA, 605 bp, Homo sapiens
tcactcaaatccttttaaaaataaaagcctccaggtccctatataagtctttccagctaccacccactgcttccctcctcatttgagactcttggtgttccagcctctctgcatctctaattccagacgcctcctttccttgagcccaggcccaaaaccactgttctactgcacctgctctcccaaagcccaccactttcttggagctgccacatccactagatacatttcagcctgtgtcttagtggatgcctctgctgcatctggcatcattgacctgtcctccccacaactattagatgctatttgcttttctggttcttctggagctctctcacctttcctgctcactctcctttcttcatttttttctgcccactccttcaatgctgctgtccctaatggttctatcttttgttacagtctttgtctttcactctgccttctcactcctctgtctccaattctcgtccactcccacaaccctccagcccccgttctcatactctccatgctctccttggagcagaaagttgtatctccttccacggttctaactcttacctttcactaagggatccaaagtcttctctccagctatagat

SEQ ID NO: 322428 - DNA, 457 bp, Homo sapiens
gtgccctttccccagcaccagccagtctaaccctatccccaggagcccgagtgagtgatttgatacagatcactttttttctgtcctgcagagttgaggcctagatagcttttagttcccagcctgtcctatttgcccactaatgagacaaattgtaggctccataaaaaattaaatagcagctgcttcattttcttcctattgaactttgaaatgatgacactctcatttgcatggctgctcaaggtatgaatatctgggcctgcaggatccaagagtccttaaatttaaccagaatcatatgttttttcagattggctggtgtaaaatattttgagaaccattcatgaaccgaaccattagctgtgcaaatggagcacgtgatttctgctcaccctgttggctgctaattaataatatcttcctggtggaggtactacctgcaggcttctcactg

SEQ ID NO: 322429 - DNA, 1475 bp, Homo sapiens
tcctggagaacttcagtgttgctactgaagaaagtgcagagcctctgagtgaggatgactttgagatgttctatgaggtttgggagaagtttgatcccgatgcaactcagttcatggaatttgaaaaattatctcagtttgcagctgcgcttgaaccgcctctcaatctgccacaaccaaacaaactccagctcattgccatggatttgcccatggtgagtggtgaccggatccactgtcttgatatcttatttgcttttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaagcttcctttacgtacaataaaaacaaaatcaaaggtggggctaatcttcttataaaagaagacatgataattgacagaataaatgaaaactctattacagaaaaaactgatctgaccatgtccactgcagcttgtccaccttcctatgaccgggtgacaaagccaattgtggaaaaacatgagcaagaaggcaaagatgaaaaagccaaagggaaataaatgaaaataaataaaaataattgggtgacaaattgtttacagcctgtgaaggtgatgtatttttatcaacaggactcctttaggaggtcaatgccaaactgactgtttttacacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattggggtgataagtggaggtgctttgttgatcttgttttgcggaaatccagcccctaggaccaagtagattgtttgtggggtaggccagtaaatcttagcaggtgcaaacttcattcaaatgtttggagtcataaatgttatgttt

SEQ ID NO: 322430 - DNA, 456 bp, Homo sapiens
tgctcaggagtttgcaaagctctttttgggctgttcgcttatctgagccacacagcaacccctaaggtgggattatcatcatggtgccccattaaggaaaccgaggttaaaggacttgattaaggtcacacagttaaagagctgtggagccaaagcacaaactcaaggcatctgttttcaaattccatgtctgcacaggacagaattctgtccagacacacaatctggggggagagttggcatgaaccacttagcggcaaggggtgaggggcagtgcaagttgtctctagggctggcatgccacacactcatctcagtgccctcactgtctagaaaatgctgcattttgcagtccagcttttttttttttgttgaaggttatccttggaaaggatctctgatcagtggaaacgatttgtttttgagctgattagcttgttgaggaaaaccatcatt

SEQ ID NO: 322431 - DNA, 340 bp, Homo sapiens
cctggccagcatggcaaaaccccaactctaataaaaaatacaaaaaattagctgggagtggaggcaggcacctgtaatcccagctacttggaaggttgagctaggagaattgcttgaatctgggaggcagaggttgcaatgagccgagatcacaccactgcactccaccttgagcaacagactgagactctgtctcaaaaaaaaaaaaattatgcaaagtgtcttttccaacaaaagtgtaatgaagctagaagtcaataacaggaaaacctggagaatttgcaagtaagtgaaagttaaacaacattcttaaccagtggctcaaagaagaaatgactag

SEQ ID NO: 322432 - DNA, 392 bp, Homo sapiens
accaacaccacaatcaaggtagcaaagaaagggagctgaaattaaagcaagggaggcagataacatttgaaaatgtgtgtaatcaaccatattacaaggccagaaatgaaaagccttataatcatcccagtacatgcaggaaaagcatgtgacaaaatcagacatctattcctgataaaacctctcagcaaactaggagtagaagaggcatttcttcactgtccttttccgctgtatagatgtgcagatttgcctcatcctaaagtgtcctgtgtcacagtggagcagggaggcaggtgtgtgctggctgcatggggtagcaggttaggttagtaacgaatctgtggccagctggcaccctggcttcttggatgggaaagtggcttaatacc

SEQ ID NO: 322433 - DNA, 85 bp, Homo sapiens
atgtgagtacaataccttttagaatgtaacaatgttggtttgatactgtaaattttactaattaaagaggagaagacttgaggcc

SEQ ID NO: 322434 - DNA, 3911 bp, Homo sapiens
ggctccgaaggtccccggcttcgtggctagccggggtcctagcgctggaaaggtggccgtagcggccgcctgacccctacaaaagtctgggacaggggcagcgacaaaggccttgggaggacgcccatggtcggagggatctcgccccgggagaaaagttgggacaggagcgcgggatcgaagggtggactccgagccggcctgtcagcgaagagcgttgcaggtgcggtggcggaagtgcagggacggaggccgaagcggagcggtctagggagccgcggccgcgggtcacccggcgggtagcagttgctgagtgtcagctagacagcagcgactagggctcgggcgccggcgagatgcctttgttcaccgccaaccccttcgagcaagacgtggaaaaagccacgaatgagtacaacactacagaagattggagtcttattatggacatatgtgacaaagttggaagtactcctaatggagcgaaagattgcctaaaagccataatgaaaagggtaaatcataaggttccacatgttgctctgcaagcactaactcttcttggggcttgtgtggcaaactgtggaaagatatttcatttagaagtatgttcccgtgattttgcaacagaagtacgtgctgtgattaaaaataaggcacatcctaaagtatgtgaaaaactgaaatctttaatggtggagtggtcagaagaatttcagaaggaccctcagtttagtctgatatctgcaactattaaatctatgaaagaagaaggaattacttttcctccagcaggttctcagactgtctcagctgctgccaagaatggtacgtcatcgaacaaaaacaaagaggatgaagacatagctaaagctattgaattatcgctgcaagaacagaaacagcaacacacagaaacaaaatccttatatccatcttcagaaattcagttaaataataaggttgcacggaaagtgagagctttatatgattttgaagctgttgaggacaatgaactcacctttaaacatggtgaaataattattgttttggatgacagtgatgccaattggtggaaaggagaaaatcacagaggaataggacttttcccatccaattttgtaacaactaatttaaacatagagactgaggcagcggctgtggacaaattgaatgtaattgatgatgatgtggaggaaattaagaaatcagagcctgagcctgtttatatagatgaggataagatggatagagccctgcaggtacttcagagtatagatccaacagattcaaaaccagactcccaagaccttttggatttagaagatatctgccaacagatgggtccaatgatagatgaaaaacttgaagaaattgataggaagcattcagaattgtctgaattgaatgttaaagtcctggaagctctggaactatataacaaattggtgaatgaagcaccagtgtactcagtctattcaaagctccaccctccagcacattacccacctgcatcatctggggttccaatgcagacatatccagttcaatcacatggtggaaactatatgggtcagagcattcaccaagtaactgttgcccaaagctatagcctaggacccgatcaaattggtccactgagatctctgcctccaaatgtgaattcctcagtgacagcacagcctgctcaaacttcatatttaagcactggacaagacactgtttccaatcctacttatatgaaccagaactctaacctacagtcagctactggtacaactgcttacacacagcaaatggggatgtctgtggatatgtcatcttatcagaacactacttccaatttgcctcaactggcaggctttccggtgacagttccagctcatccagttgcacagcagcacacaaattaccatcagcagcctctcctttagaaacaaatcaagcattttcttgaaagccttcataagtgtattattcagtccttgtgataccaacctgaaaatattaaaacttttttccctctcaactcaaaaggaccatgaataaataaagcacaaaaacctctcttattctacaaggccataaaaggttttttttttttttttttttcagtccagtttgtttgaagtcaatcttttcatcagaggcagcttaaagatgctttcagttagttttgtcttactttcagatttctctacataaatctagatactcattaagtagccttatgacaaacagtatgagatacttatgacaaactcgctctgtcacccaggctggagtgcagtagcatgatcgacagagtgagtttgtcaaaagtatctcatacttataaacagtatgagataggaggattaaaatattattttaaagaaaccactgtttccccctaaaatgtcataagagcactgaagaacttgaaatatttttttcagagtttctcacacactttaaaagtctaacttttttgtgtgtaagcatttagcttgccagcatatttctttttggctccttaaattgcggttgtgtttgcagtattgtcacttttgctctcactgttatgttgaataataattagcatataattgtctacagaagcaagagcaatctggaaggaacaaaaatgttttctgtgattaacagtgaagaccttgtaaatgcagatgtgtgataaagcatttagtcagtcccccaaacagtcatgccaactgtgaaggaatgtcccacaaaacatttccattccctgaggaaaaacattttctttcctacatgtatctctggtatttagaattgtcactaataaccttttcaagtgattttggctattctctaatgaagatatggtccatttgtttttcttcctgcaatgtggtgtgcagagatgctgcatatcctttttatgggattgcgtgtgaatttgaaccatgagacattcctaataatttgttgtgagatataccaagcatggatgataagtgtgtttttagtggtgtgttgtttttttaaagaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcctgcattttgagttagtttatagtgctaatagattctatataactgtgagagtttggtagtaaaccagtagggattgttttctctcctaaaaatttgcacactacttcattgtctaccaactttttacatattggaaaatagaaattgcaaatacatacatgtatggaaacatattcagattgggaaaaacaatggacattagtttttaaaaagttacgtggaagcaagatttctatatttgtttttttaaaggaagcagtcattctttctactaaatccatttcaagctagttctctgaaaattttgccatttatctacagaaatttgattataaatatgttcctttttcaaagaaactttattctagaacaaaatagtctatatggtacttgatctacatttaagtggaaaaattagcagtatttgaaagctcagtttatgtcattgtcttaacttcagatacaaataactgaacagaaagttttaacctttaatatctcatgttctgttttttattcagtattttcctttatgttaattcaattatatacttctgaatggcaccttactttttggaaacaaatcttctgttatttacaaaataataatttttaaaaaacatttaaaaaaaatccaaagctgctctcgataatagtcaacatttgcatatatatggaatttcttactttttttctcccaaactctatttaataaacttattttaatgtttgtgta

SEQ ID NO: 322435 - DNA, 5731 bp, Homo sapiens
ggctccgaaggtccccggcttcgtggctagccggggtcctagcgctggaaaggtggccgtagcggccgcctgacccctacaaaagtctgggacaggggcagcgacaaaggccttgggaggacgcccatggtcggagggatctcgccccgggagaaaagttgggacaggagcgcgggatcgaagggtggactccgagccggcctgtcagcgaagagcgttgcaggtgcggtggcggaagtgcagggacggaggccgaagcggagcggtctagggagccgcggccgcgggtcacccggcgggtagcagttgctgagtgtcagctagacagcagcgactagggctcgggcgccggcgagatgcctttgttcaccgccaaccccttcgagcaagacgtggaaaaagccacgaatgagtacaacactacagaagattggagtcttattatggacatatgtgacaaagttggaagtactcctaatggagcgaaagattgcctaaaagccataatgaaaagggtaaatcataaggttccacatgttgctctgcaagcactaactcttcttggggcttgtgtggcaaactgtggaaagatatttcatttagaagtatgttcccgtgattttgcaacagaagtacgtgctgtgattaaaaataaggcacatcctaaagtatgtgaaaaactgaaatctttaatggtggagtggtcagaagaatttcagaaggaccctcagtttagtctgatatctgcaactattaaatctatgaaagaagaaggaattacttttcctccagcaggttctcagactgtctcagctgctgccaagaatggtacgtcatcgaacaaaaacaaagaggatgaagacatagctaaagctattgaattatcgctgcaagaacagaaacagcaacacacagaaacaaaatccttatatccatcttcagaaattcagttaaataataaggttgcacggaaagtgagagctttatatgattttgaagctgttgaggacaatgaactcacctttaaacatggtgaaataattattgttttggatgacagtgatgccaattggtggaaaggagaaaatcacagaggaataggacttttcccatccaattttgtaacaactaatttaaacatagagactgaggcagcggctgtggacaaattgaatgtaattgatgatgatgtggaggaaattaagaaatcagagcctgagcctgtttatatagatgaggataagatggatagagccctgcaggtacttcagagtatagatccaacagattcaaaaccagactcccaagaccttttggatttagaagatatctgccaacagatgggtccaatgatagatgaaaaacttgaagaaattgataggaagcattcagaattgtctgaattgaatgttaaagtcctggaagctctggaactatataacaaattggtgaatgaagcaccagtgtactcagtctattcaaagctccaccctccagcacattacccacctgcatcatctggggttccaatgcagacatatccagttcaatcacatggtggaaactatatgggtcagagcattcaccaagtaactgttgcccaaagctatagcctaggacccgatcaaattggtccactgagatctctgcctccaaatgtgaattcctcagtgacagcacagcctgctcaaacttcatatttaagcactggacaagacactgtttccaatcctacttatatgaaccagaactctaacctacagtcagctactggtacaactgcttacacacagcaaatggggatgtctgtggatatgtcatcttatcagaacactacttccaatttgcctcaactggcaggctttccggtgacagttccagctcatccagttgcacagcagcacacaaattaccatcagcagcctctcctttagaaacaaatcaagcattttcttgaaagccttcataagtgtattattcagtccttgtgataccaacctgaaaatattaaaacttttttccctctcaactcaaaaggaccatgaataaataaagcacaaaaacctctcttattctacaaggccataaaaggttttttttttttttttttttcagtccagtttgtttgaagtcaatcttttcatcagaggcagcttaaagatgctttcagttagttttgtcttactttcagatttctctacataaatctagatactcattaagtagccttatgacaaacagtatgtcaaaagtatctcatacttataaacagtatgagataggaggattaaaatattattttaaagaaaccactgtttccccctaaaatgtcataagagcactgaagaacttgaaatatttttttcagagtttctcacacactttaaaagtctaacttttttgtgtgtaagcatttagcttgccagcatatttctttttggctccttaaattgcggttgtgtttgcagtattgtcacttttgctctcactgttatgttgaataataattagcatataattgtctacagaagcaagagcaatctggaaggaacaaaaatgttttctgtgattaacagtgaagaccttgtaaatgcagatgtgtgataaagcatttagtcagtcccccaaacagtcatgccaactgtgaaggaatgtcccacaaaacatttccattccctgaggaaaaacattttctttcctacatgtatctctggtatttagaattgtcactaataaccttttcaagtgattttggctattctctaatgaagatatggtccatttgtttttcttcctgcaatgtggtgtgcagagatgctgcatatcctttttatgggattgcgtgtgaatttgaaccatgagacattcctaataatttgttgtgagatataccaagcatggatgataagtgtgtttttagtggtgtgttgtttttttaaagaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcctgcattttgagttagtttatagtgctaatagattctatataactgtgagagtttggtagtaaaccagtagggattgttttctctcctaaaaatttgcacactacttcattgtctaccaactttttacatattggaaaatagaaattgcaaatacatacatgtatggaaacatattcagattgggaaaaacaatggacattagtttttaaaaagttacgtggaagcaagatttctatatttgtttttttaaaggaagcagtcattctttctactaaatccatttcaagctagttctctgaaaattttgccatttatctacagaaatttgattataaatatgttcctttttcaaagaaactttattctagaacaaaatagtctatatggtacttgatctacatttaagtggaaaaattagcagtatttgaaagctcagtttatgtcattgtcttaacttcagatacaaataactgaacagaaagttttaacctttaatatctcatgttctgttttttattcagtattttcctttatgttaattcaattatatacttctgaatggcaccttactttttggaaacaaatcttctgttatttacaaaataataatttttaaaaaacatttaaaaaaaatccaaagctgctctcgataatagtcaacatttgcatatatatggaatttcttactttttttctcccaaactctatttaataaacttattttaatgtttgtgtatttcatgtataattgtgatctcaattataaaagtttaattcagcatgtctttgagccaatataattactgcacacccactaaattgggatcagccattataaataatgtagttttagaataataaaacatgacacatatatatatatataaatatatagtatatattggcacatcggtgaaagtttatatgtgcagaagtttttttctttctcaagttaaaaattattttttgccatatgtaattttgtgttgcaggctgtcgagagataaaaatgattttaaatctgtgtactgatgattctttcggtgttaagaaacacagggttgtgtacttccctttttatgggcttatggattctatttatattaagacctgtttataattgttttctgccaaagggaattgtctaacttcagatttctacattgggttcatacttactgttttatatcagaaataaaaaaatagcttctgctttttcatatgaaatcttggtacatcagaaagaattcctgaaaatttataatagaatgaattttattaatgcagaaaaataccccagggtgttaaaatatatgaagtgtgggatatattcttatagtttgtaaaatgtagtcaaccaatactgtcttctaatttggtaatttatttataaaattacttaaacattaggtaattatatttgttaggatttgaaattatttgtagttaaattgtcatgctgtttgaaataattgatacttgtctacgtaatacattttactgtatgttttgaagatggttataatttcactttcaaaatttaaaaaatcaattttaaatgttttaaaaacatatagcttagggattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattcaaaagtatatttctaaaagttttccccagaggccagatacagtggctcatgcctataatcccagcactttgggagcctgagataggagtattgcttgaggctaggagtttgagaccaacctggcaacatggcaagaccctatctctacaaaaattttaaaacttagccaggtgtggtagtgcacctgtagtcccagctagtcagtaggctgaggtgggagtattgcttgaggctgcagtgaggtgtgatcacgccactgcactccggcctgacagaatgagatcctgtctcaaaaagaaaattccccagaagaagaattctaattttatcaagctgaattaaagtttgagagtcttttttttaaaatcttactgtgtcaaaagaggcattatgttgcttgtgtgatatagtgaatagtgtccctccaaatttcatgtacacctggaatgtcacaatgtgacttaacagtagccacccctcacccccgcccttatctgtggtggatacatttgcaagatccccagtggatgcctgaaaccgcagatagtactgaaccttatatatactgtttgttttcctatgcatacatatccctatgataaagtttatgaatttggcacttaacagcagaactaataagatgaaagagttgtaacaatatactctaataaaagttatttaaaatgtatgtattgttatctgtaattttgcatttaatatttttggaccatggtttaatctgggtaactgaaaacacagaaagtgaaatcatgggccgggc

SEQ ID NO: 322436 - DNA, 5032 bp, Homo sapiens
gtaatgtgattgtacttaatatagcttatttggcatttctagcattctaaattttcagatgaatggtatttactttaaaaatagcttaatttaaaactggattgatgatcattatggtatgatatgatattaaatgtatgcattgttttgatgctatatttagtagacaggtggtagaccctgtccttaaggagctgttgtcctgaaaataagtagggcacatataaatgtccaaagagacctaaaccatttttgctgtttcctgaggatacatgtcttttgcccataactcttctttacttttgtcctgtttgtcttaaaggtagagaataaggtagacattgccagggaagccctggcacccttataccatttctttttcagctttttctctcaagtttctttcttaggaaggagttggatgagtcatcctgggatgagggtaaagaaggttatcattcttatagtgactttaagtgatggtgggcttcccttcaagggagtgtatagttttctgtggctctacagcaagacatctttactgagtaataggcaacctggatagattgcaatccactacttaaaagtacaccacctgtctttctcccagctctctgtaaaaataaaagaacagccaaacaaatcaaatttccatagatttggcactgtgatttgacagctctccacttttagttctaagatggatagattggtagaatcagattgcttcccaaagaagtatagtttctttcctttaagtcttttaacattttaaatatattattaggcacatgtttgggagatgagtgaatcaactttttctttctgattaatagacatatccagttcaatcacatggtggaaactatatgggtcagagcattcaccaagtaactgttgcccaaagctatagcctaggacccgatcaaattggtccactgagatctctgcctccaaatgtgaattcctcagtgacagcacagcctgctcaaacttcatatttaagcactggacaagacactgtttccaatcctacttatatgaaccagaactctaacctacagtcagctactggtacaactgcttacacacagcaaatggggatgtctgtggatatgtcatcttatcagaacactacttccaatttgcctcaactggcaggctttccggtgacagttccagctcatccagttgcacagcagcacacaaattaccatcagcagcctctcctttagaaacaaatcaagcattttcttgaaagccttcataagtgtattattcagtccttgtgataccaacctgaaaatattaaaacttttttccctctcaactcaaaaggaccatgaataaataaagcacaaaaacctctcttattctacaaggccataaaaggttttttttttttttttttttcagtccagtttgtttgaagtcaatcttttcatcagaggcagcttaaagatgctttcagttagttttgtcttactttcagatttctctacataaatctagatactcattaagtagccttatgacaaacagtatgtcaaaagtatctcatacttataaacagtatgagataggaggattaaaatattattttaaagaaaccactgtttccccctaaaatgtcataagagcactgaagaacttgaaatatttttttcagagtttctcacacactttaaaagtctaacttttttgtgtgtaagcatttagcttgccagcatatttctttttggctccttaaattgcggttgtgtttgcagtattgtcacttttgctctcactgttatgttgaataataattagcatataattgtctacagaagcaagagcaatctggaaggaacaaaaatgttttctgtgattaacagtgaagaccttgtaaatgcagatgtgtgataaagcatttagtcagtcccccaaacagtcatgccaactgtgaaggaatgtcccacaaaacatttccattccctgaggaaaaacattttctttcctacatgtatctctggtatttagaattgtcactaataaccttttcaagtgattttggctattctctaatgaagatatggtccatttgtttttcttcctgcaatgtggtgtgcagagatgctgcatatcctttttatgggattgcgtgtgaatttgaaccatgagacattcctaataatttgttgtgagatataccaagcatggatgataagtgtgtttttagtggtgtgttgtttttttaaagaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcctgcattttgagttagtttatagtgctaatagattctatataactgtgagagtttggtagtaaaccagtagggattgttttctctcctaaaaatttgcacactacttcattgtctaccaactttttacatattggaaaatagaaattgcaaatacatacatgtatggaaacatattcagattgggaaaaacaatggacattagtttttaaaaagttacgtggaagcaagatttctatatttgtttttttaaaggaagcagtcattctttctactaaatccatttcaagctagttctctgaaaattttgccatttatctacagaaatttgattataaatatgttcctttttcaaagaaactttattctagaacaaaatagtctatatggtacttgatctacatttaagtggaaaaattagcagtatttgaaagctcagtttatgtcattgtcttaacttcagatacaaataactgaacagaaagttttaacctttaatatctcatgttctgttttttattcagtattttcctttatgttaattcaattatatacttctgaatggcaccttactttttggaaacaaatcttctgttatttacaaaataataatttttaaaaaacatttaaaaaaaatccaaagctgctctcgataatagtcaacatttgcatatatatggaatttcttactttttttctcccaaactctatttaataaacttattttaatgtttgtgtatttcatgtataattgtgatctcaattataaaagtttaattcagcatgtctttgagccaatataattactgcacacccactaaattgggatcagccattataaataatgtagttttagaataataaaacatgacacatatatatatatataaatatatagtatatattggcacatcggtgaaagtttatatgtgcagaagtttttttctttctcaagttaaaaattattttttgccatatgtaattttgtgttgcaggctgtcgagagataaaaatgattttaaatctgtgtactgatgattctttcggtgttaagaaacacagggttgtgtacttccctttttatgggcttatggattctatttatattaagacctgtttataattgttttctgccaaagggaattgtctaacttcagatttctacattgggttcatacttactgttttatatcagaaataaaaaaatagcttctgctttttcatatgaaatcttggtacatcagaaagaattcctgaaaatttataatagaatgaattttattaatgcagaaaaataccccagggtgttaaaatatatgaagtgtgggatatattcttatagtttgtaaaatgtagtcaaccaatactgtcttctaatttggtaatttatttataaaattacttaaacattaggtaattatatttgttaggatttgaaattatttgtagttaaattgtcatgctgtttgaaataattgatacttgtctacgtaatacattttactgtatgttttgaagatggttataatttcactttcaaaatttaaaaaatcaattttaaatgttttaaaaacatatagcttagggattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattcaaaagtatatttctaaaagttttccccagaggccagatacagtggctcatgcctataatcccagcactttgggagcctgagataggagtattgcttgaggctaggagtttgagaccaacctggcaacatggcaagaccctatctctacaaaaattttaaaacttagccaggtgtggtagtgcacctgtagtcccagctagtcagtaggctgaggtgggagtattgcttgaggctgcagtgaggtgtgatcacgccactgcactccggcctgacagaatgagatcctgtctcaaaaagaaaattccccagaagaagaattctaattttatcaagctgaattaaagtttgagagtcttttttttaaaatcttactgtgtcaaaagaggcattatgttgcttgtgtgatatagtgaatagtgtccctccaaatttcatgtacacctggaatgtcacaatgtgacttaacagtagccacccctcacccccgcccttatctgtggtggatacatttgcaagatccccagtggatgcctgaaaccgcagatagtactgaaccttatatatactgtttgttttcctatgcatacatatccctatgataaagtttatgaatttggcacttaacagcagaactaataagatgaaagagttgtaacaatatactctaataaaagttatttaaaatgtatgtattgttatctgtaattttgcatttaatatttttggaccatggtttaatctgggtaactgaaaacacagaaagtgaaatcatgggccgggc

SEQ ID NO: 322437 - DNA, 5795 bp, Homo sapiens
ggctccgaaggtccccggcttcgtggctagccggggtcctagcgctggaaaggtggccgtagcggccgcctgacccctacaaaagtctgggacaggggcagcgacaaaggccttgggaggacgcccatggtcggagggatctcgccccgggagaaaagttgggacaggagcgcgggatcgaagggtggactccgagccggcctgtcagcgaagagcgttgcaggtgcggtggcggaagtgcagggacggaggccgaagcggagcggtctagggagccgcggccgcgggtcacccggcgggtagcagttgctgagtgtcagctagacagcagcgactagggctcgggcgccggcgagatgcctttgttcaccgccaaccccttcgagcaagacgtggaaaaagccacgaatgagtacaacactacagaagattggagtcttattatggacatatgtgacaaagttggaagtactcctaatggagcgaaagattgcctaaaagccataatgaaaagggtaaatcataaggttccacatgttgctctgcaagcactaactcttcttggggcttgtgtggcaaactgtggaaagatatttcatttagaagtatgttcccgtgattttgcaacagaagtacgtgctgtgattaaaaataaggcacatcctaaagtatgtgaaaaactgaaatctttaatggtggagtggtcagaagaatttcagaaggaccctcagtttagtctgatatctgcaactattaaatctatgaaagaagaaggaattacttttcctccagcaggttctcagactgtctcagctgctgccaagaatggtacgtcatcgaacaaaaacaaagaggatgaagacatagctaaagctattgaattatcgctgcaagaacagaaacagcaacacacagaaacaaaatccttatatccatcttcagaaattcagttaaataataaggttgcacggaaagtgagagctttatatgattttgaagctgttgaggacaatgaactcacctttaaacatggtgaaataattattgttttggatgacagtgatgccaattggtggaaaggagaaaatcacagaggaataggacttttcccatccaattttgtaacaactaatttaaacatagagactgaggcagcggctgtggacaaattgaatgtaattgatgatgatgtggaggaaattaagaaatcagagcctgagcctgtttatatagatgaggataagatggatagagccctgcaggtacttcagagtatagatccaacagattcaaaaccagactcccaagaccttttggatttagaagatatctgccaacagatgggtccaatgatagatgaaaaacttgaagaaattgataggaagcattcagaattgtctgaattgaatgttaaagtcctggaagctctggaactatataacaaattggtgaatgaagcaccagtgtactcagtctattcaaagctccaccctccagcacattacccacctgcatcatctggggttccaatgcagacatatccagttcaatcacatggtggaaactatatgggtcagagcattcaccaagtaactgttgcccaaagctatagcctaggacccgatcaaattggtccactgagatctctgcctccaaatgtgaattcctcagtgacagcacagcctgctcaaacttcatatttaagcactggacaagacactgtttccaatcctacttatatgaaccagaactctaacctacagtcagctactggtacaactgcttacacacagcaaatggggatgtctgtggatatgtcatcttatcagaacactacttccaatttgcctcaactggcaggctttccggtgacagttccagctcatccagttgcacagcagcacacaaattaccatcagcagcctctcctttagaaacaaatcaagcattttcttgaaagccttcataagtgtattattcagtccttgtgataccaacctgaaaatattaaaacttttttccctctcaactcaaaaggaccatgaataaataaagcacaaaaacctctcttattctacaaggccataaaaggttttttttttttttttttttcagtccagtttgtttgaagtcaatcttttcatcagaggcagcttaaagatgctttcagttagttttgtcttactttcagatttctctacataaatctagatactcattaagtagccttatgacaaacagtatgtcaaaagtatctcatacttataaacagtatgagataggaggattaaaatattattttaaagaaaccactgtttccccctaaaatgtcataagagcactgaagaacttgaaatatttttttcagagtttctcacacactttaaaagtctaacttttttgtgtgtaagcatttagcttgccagcatatttctttttggctccttaaattgcggttgtgtttgcagtattgtcacttttgctctcactgttatgttgaataataattagcatataattgtctacagaagcaagagcaatctggaaggaacaaaaatgttttctgtgattaacagtgaagaccttgtaaatgcagatgtgtgataaagcatttagtcagtcccccaaacagtcatgccaactgtgaaggaatgtcccacaaaacatttccattccctgaggaaaaacattttctttcctacatgtatctctggtatttagaattgtcactaataaccttttcaagtgattttggctattctctaatgaagatatggtccatttgtttttcttcctgcaatgtggtgtgcagagatgctgcatatcctttttatgggattgcgtgtgaatttgaaccatgagacattcctaaaaacacacttatcatccatgcttggtatatctcacaacaaattattaggaatgtctcatggttctaatttgttgtgagatataccaagcatggatgataagtgtgtttttagtggtgtgttgtttttttaaagaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcctgcattttgagttagtttatagtgctaatagattctatataactgtgagagtttggtagtaaaccagtagggattgttttctctcctaaaaatttgcacactacttcattgtctaccaactttttacatattggaaaatagaaattgcaaatacatacatgtatggaaacatattcagattgggaaaaacaatggacattagtttttaaaaagttacgtggaagcaagatttctatatttgtttttttaaaggaagcagtcattctttctactaaatccatttcaagctagttctctgaaaattttgccatttatctacagaaatttgattataaatatgttcctttttcaaagaaactttattctagaacaaaatagtctatatggtacttgatctacatttaagtggaaaaattagcagtatttgaaagctcagtttatgtcattgtcttaacttcagatacaaataactgaacagaaagttttaacctttaatatctcatgttctgttttttattcagtattttcctttatgttaattcaattatatacttctgaatggcaccttactttttggaaacaaatcttctgttatttacaaaataataatttttaaaaaacatttaaaaaaaatccaaagctgctctcgataatagtcaacatttgcatatatatggaatttcttactttttttctcccaaactctatttaataaacttattttaatgtttgtgtatttcatgtataattgtgatctcaattataaaagtttaattcagcatgtctttgagccaatataattactgcacacccactaaattgggatcagccattataaataatgtagttttagaataataaaacatgacacatatatatatatataaatatatagtatatattggcacatcggtgaaagtttatatgtgcagaagtttttttctttctcaagttaaaaattattttttgccatatgtaattttgtgttgcaggctgtcgagagataaaaatgattttaaatctgtgtactgatgattctttcggtgttaagaaacacagggttgtgtacttccctttttatgggcttatggattctatttatattaagacctgtttataattgttttctgccaaagggaattgtctaacttcagatttctacattgggttcatacttactgttttatatcagaaataaaaaaatagcttctgctttttcatatgaaatcttggtacatcagaaagaattcctgaaaatttataatagaatgaattttattaatgcagaaaaataccccagggtgttaaaatatatgaagtgtgggatatattcttatagtttgtaaaatgtagtcaaccaatactgtcttctaatttggtaatttatttataaaattacttaaacattaggtaattatatttgttaggatttgaaattatttgtagttaaattgtcatgctgtttgaaataattgatacttgtctacgtaatacattttactgtatgttttgaagatggttataatttcactttcaaaatttaaaaaatcaattttaaatgttttaaaaacatatagcttagggattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattcaaaagtatatttctaaaagttttccccagaggccagatacagtggctcatgcctataatcccagcactttgggagcctgagataggagtattgcttgaggctaggagtttgagaccaacctggcaacatggcaagaccctatctctacaaaaattttaaaacttagccaggtgtggtagtgcacctgtagtcccagctagtcagtaggctgaggtgggagtattgcttgaggctgcagtgaggtgtgatcacgccactgcactccggcctgacagaatgagatcctgtctcaaaaagaaaattccccagaagaagaattctaattttatcaagctgaattaaagtttgagagtcttttttttaaaatcttactgtgtcaaaagaggcattatgttgcttgtgtgatatagtgaatagtgtccctccaaatttcatgtacacctggaatgtcacaatgtgacttaacagtagccacccctcacccccgcccttatctgtggtggatacatttgcaagatccccagtggatgcctgaaaccgcagatagtactgaaccttatatatactgtttgttttcctatgcatacatatccctatgataaagtttatgaatttggcacttaacagcagaactaataagatgaaagagttgtaacaatatactctaataaaagttatttaaaatgtatgtattgttatctgtaattttgcatttaatatttttggaccatggtttaatctgggtaactgaaaacacagaaagtgaaatcatgggccgggc

SEQ ID NO: 322438 - DNA, 5677 bp, Homo sapiens
ggctccgaaggtccccggcttcgtggctagccggggtcctagcgctggaaaggtggccgtagcggccgcctgacccctacaaaagtctgggacaggggcagcgacaaaggccttgggaggacgcccatggtcggagggatctcgccccgggagaaaagttgggacaggagcgcgggatcgaagggtggactccgagccggcctgtcagcgaagagcgttgcaggtgcggtggcggaagtgcagggacggaggccgaagcggagcggtctagggagccgcggccgcgggtcacccggcgggtagcagttgctgagtgtcagctagacagcagcgactagggctcgggcgccggcgagatgcctttgttcaccgccaaccccttcgagcaagacgtggaaaaagccacgaatgagtacaacactacagaagattggagtcttattatggacatatgtgacaaagttggaagtactcctaatggagcgaaagattgcctaaaagccataatgaaaagggtaaatcataaggttccacatgttgctctgcaagcactaactcttcttggggcttgtgtggcaaactgtggaaagatatttcatttagaagtatgttcccgtgattttgcaacagaagtacgtgctgtgattaaaaataaggcacatcctaaagtatgtgaaaaactgaaatctttaatggtggagtggtcagaagaatttcagaaggaccctcagtttagtctgatatctgcaactattaaatctatgaaagaagaaggaattacttttcctccagcaggttctcagactgtctcagctgctgccaagaatggtacgtcatcgaacaaaaacaaagaggatgaagacatagctaaagctattgaattatcgctgcaagaacagaaacagcaacacacagaaacaaaatccttatatccatcttcagaaattcagttaaataataaggttgcacggaaagtgagagctttatatgattttgaagctgttgaggacaatgaactcacctttaaacatggtgaaataattattgttttggatgacagtgatgccaattggtggaaaggagaaaatcacagaggaataggacttttcccatccaattttgtaacaactaatttaaacatagagactgaggcagcggctgtggacaaattgaatgtaattgatgatgatgtggaggaaattaagaaatcagagcctgagcctgtttatatagatgaggataagatggatagagccctgcaggtacttcagagtatagatccaacagattcaaaaccagactcccaagaccttttggatttagaagatatctgccaacagatgggtccaatgatagatgaaaaacttgaagaaattgataggaagcattcagaattgtctgaattgaatgttaaagtcctggaagctctggaactatataacaaattggtgaatgaagcaccagtgtactcagtctattcaaagctccaccctccagcacattacccacctgcatcatctggggttccaatgcagacatatccagttcaatcacatggtggaaactatatgggtcagagcattcaccaagtaactgttgcccaaagctatagcctaggacccgatcaaattggtccactgagatctctgcctccaaatgtgaattcctcagtgacagcacagcctgctcaaacttcatatttaagcactggacaagacactgtttccaatcctacttatatgaaccagaactctaacctacagtcagctactggtacaactgcttacacacagcaaatggggatgtctgtggatatgtcatcttatcagaacactacttccaatttgcctcaactggcaggctttccggtgacagttccagctcatccagttgcacagcagcacacaaattaccatcagcagcctctcctttagaaacaaatcaagcattttcttgaaagccttcataagtgtattattcagtccttgtgataccaacctgaaaatattaaaacttttttccctctcaactcaaaaggaccatgaataaataaagcacaaaaacctctcttattctacaaggccataaaaggttttttttttttttttttttcagtccagtttgtttgaagtcaatcttttcatcagaggcagcttaaagatgctttcagttagttttgtcttactttcagatttctctacataaatctagatactcattaagtagccttatgacaaacagtatgtcaaaagtatctcatacttataaacagtatgagataggaggattaaaatattattttaaagaaaccactgtttccccctaaaatgtcataagagcactgaagaacttgaaatatttttttcagagtttctcacacactttaaaagtctaacttttttgtgtgtaagcatttagcttgccagcatatttctttttggctccttaaattgcggttgtgtttgcagtattgtcacttttgctctcactgttatgttgaataataattagcatataattgtctacagaagcaagagcaatctggaaggaacaaaaatgttttctgtgattaacagtgaagaccttgtaaatgcagatgtgtgataaagcatttagtcagtcccccaaacagtcatgccaactgtgaaggaatgtcccacaaaacatttccattccctgaggacttttcaagtgattttggctattctctaatgaagatatggtccatttgtttttcttcctgcaatgtggtgtgcagagatgctgcatatcctttttatgggattgcgtgtgaatttgaaccatgagacattcctaataatttgttgtgagatataccaagcatggatgataagtgtgtttttagtggtgtgttgtttttttaaagaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcctgcattttgagttagtttatagtgctaatagattctatataactgtgagagtttggtagtaaaccagtagggattgttttctctcctaaaaatttgcacactacttcattgtctaccaactttttacatattggaaaatagaaattgcaaatacatacatgtatggaaacatattcagattgggaaaaacaatggacattagtttttaaaaagttacgtggaagcaagatttctatatttgtttttttaaaggaagcagtcattctttctactaaatccatttcaagctagttctctgaaaattttgccatttatctacagaaatttgattataaatatgttcctttttcaaagaaactttattctagaacaaaatagtctatatggtacttgatctacatttaagtggaaaaattagcagtatttgaaagctcagtttatgtcattgtcttaacttcagatacaaataactgaacagaaagttttaacctttaatatctcatgttctgttttttattcagtattttcctttatgttaattcaattatatacttctgaatggcaccttactttttggaaacaaatcttctgttatttacaaaataataatttttaaaaaacatttaaaaaaaatccaaagctgctctcgataatagtcaacatttgcatatatatggaatttcttactttttttctcccaaactctatttaataaacttattttaatgtttgtgtatttcatgtataattgtgatctcaattataaaagtttaattcagcatgtctttgagccaatataattactgcacacccactaaattgggatcagccattataaataatgtagttttagaataataaaacatgacacatatatatatatataaatatatagtatatattggcacatcggtgaaagtttatatgtgcagaagtttttttctttctcaagttaaaaattattttttgccatatgtaattttgtgttgcaggctgtcgagagataaaaatgattttaaatctgtgtactgatgattctttcggtgttaagaaacacagggttgtgtacttccctttttatgggcttatggattctatttatattaagacctgtttataattgttttctgccaaagggaattgtctaacttcagatttctacattgggttcatacttactgttttatatcagaaataaaaaaatagcttctgctttttcatatgaaatcttggtacatcagaaagaattcctgaaaatttataatagaatgaattttattaatgcagaaaaataccccagggtgttaaaatatatgaagtgtgggatatattcttatagtttgtaaaatgtagtcaaccaatactgtcttctaatttggtaatttatttataaaattacttaaacattaggtaattatatttgttaggatttgaaattatttgtagttaaattgtcatgctgtttgaaataattgatacttgtctacgtaatacattttactgtatgttttgaagatggttataatttcactttcaaaatttaaaaaatcaattttaaatgttttaaaaacatatagcttagggattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattcaaaagtatatttctaaaagttttccccagaggccagatacagtggctcatgcctataatcccagcactttgggagcctgagataggagtattgcttgaggctaggagtttgagaccaacctggcaacatggcaagaccctatctctacaaaaattttaaaacttagccaggtgtggtagtgcacctgtagtcccagctagtcagtaggctgaggtgggagtattgcttgaggctgcagtgaggtgtgatcacgccactgcactccggcctgacagaatgagatcctgtctcaaaaagaaaattccccagaagaagaattctaattttatcaagctgaattaaagtttgagagtcttttttttaaaatcttactgtgtcaaaagaggcattatgttgcttgtgtgatatagtgaatagtgtccctccaaatttcatgtacacctggaatgtcacaatgtgacttaacagtagccacccctcacccccgcccttatctgtggtggatacatttgcaagatccccagtggatgcctgaaaccgcagatagtactgaaccttatatatactgtttgttttcctatgcatacatatccctatgataaagtttatgaatttggcacttaacagcagaactaataagatgaaagagttgtaacaatatactctaataaaagttatttaaaatgtatgtattgttatctgtaattttgcatttaatatttttggaccatggtttaatctgggtaactgaaaacacagaaagtgaaatcatgggccgggc

SEQ ID NO: 322439 - DNA, 4401 bp, Homo sapiens
cagcctgctgaggtctcataaaaatgaaaaaaaatttgaagaaattgataggaagcattcagaattgtctgaattgaatgttaaagtcctggaagctctggaactatataacaaattggtgaatgaagcaccagtgtactcagtctattcaaagctccaccctccagcacattacccacctgcatcatctggggttccaatgcagacatatccagttcaatcacatggtggaaactatatgggtcagagcattcaccaagtaactgttgcccaaagctatagcctaggacccgatcaaattggtccactgagatctctgcctccaaatgtgaattcctcagtgacagcacagcctgctcaaacttcatatttaagcactggacaagacactgtttccaatcctacttatatgaaccagaactctaacctacagtcagctactggtacaactgcttacacacagcaaatggggatgtctgtggatatgtcatcttatcagaacactacttccaatttgcctcaactggcaggctttccggtgacagttccagctcatccagttgcacagcagcacacaaattaccatcagcagcctctcctttagaaacaaatcaagcattttcttgaaagccttcataagtgtattattcagtccttgtgataccaacctgaaaatattaaaacttttttccctctcaactcaaaaggaccatgaataaataaagcacaaaaacctctcttattctacaaggccataaaaggttttttttttttttttttttcagtccagtttgtttgaagtcaatcttttcatcagaggcagcttaaagatgctttcagttagttttgtcttactttcagatttctctacataaatctagatactcattaagtagccttatgacaaacagtatgtcaaaagtatctcatacttataaacagtatgagataggaggattaaaatattattttaaagaaaccactgtttccccctaaaatgtcataagagcactgaagaacttgaaatatttttttcagagtttctcacacactttaaaagtctaacttttttgtgtgtaagcatttagcttgccagcatatttctttttggctccttaaattgcggttgtgtttgcagtattgtcacttttgctctcactgttatgttgaataataattagcatataattgtctacagaagcaagagcaatctggaaggaacaaaaatgttttctgtgattaacagtgaagaccttgtaaatgcagatgtgtgataaagcatttagtcagtcccccaaacagtcatgccaactgtgaaggaatgtcccacaaaacatttccattccctgaggaaaaacattttctttcctacatgtatctctggtatttagaattgtcactaataaccttttcaagtgattttggctattctctaatgaagatatggtccatttgtttttcttcctgcaatgtggtgtgcagagatgctgcatatcctttttatgggattgcgtgtgaatttgaaccatgagacattcctaataatttgttgtgagatataccaagcatggatgataagtgtgtttttagtggtgtgttgtttttttaaagaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcctgcattttgagttagtttatagtgctaatagattctatataactgtgagagtttggtagtaaaccagtagggattgttttctctcctaaaaatttgcacactacttcattgtctaccaactttttacatattggaaaatagaaattgcaaatacatacatgtatggaaacatattcagattgggaaaaacaatggacattagtttttaaaaagttacgtggaagcaagatttctatatttgtttttttaaaggaagcagtcattctttctactaaatccatttcaagctagttctctgaaaattttgccatttatctacagaaatttgattataaatatgttcctttttcaaagaaactttattctagaacaaaatagtctatatggtacttgatctacatttaagtggaaaaattagcagtatttgaaagctcagtttatgtcattgtcttaacttcagatacaaataactgaacagaaagttttaacctttaatatctcatgttctgttttttattcagtattttcctttatgttaattcaattatatacttctgaatggcaccttactttttggaaacaaatcttctgttatttacaaaataataatttttaaaaaacatttaaaaaaaatccaaagctgctctcgataatagtcaacatttgcatatatatggaatttcttactttttttctcccaaactctatttaataaacttattttaatgtttgtgtatttcatgtataattgtgatctcaattataaaagtttaattcagcatgtctttgagccaatataattactgcacacccactaaattgggatcagccattataaataatgtagttttagaataataaaacatgacacatatatatatatataaatatatagtatatattggcacatcggtgaaagtttatatgtgcagaagtttttttctttctcaagttaaaaattattttttgccatatgtaattttgtgttgcaggctgtcgagagataaaaatgattttaaatctgtgtactgatgattctttcggtgttaagaaacacagggttgtgtacttccctttttatgggcttatggattctatttatattaagacctgtttataattgttttctgccaaagggaattgtctaacttcagatttctacattgggttcatacttactgttttatatcagaaataaaaaaatagcttctgctttttcatatgaaatcttggtacatcagaaagaattcctgaaaatttataatagaatgaattttattaatgcagaaaaataccccagggtgttaaaatatatgaagtgtgggatatattcttatagtttgtaaaatgtagtcaaccaatactgtcttctaatttggtaatttatttataaaattacttaaacattaggtaattatatttgttaggatttgaaattatttgtagttaaattgtcatgctgtttgaaataattgatacttgtctacgtaatacattttactgtatgttttgaagatggttataatttcactttcaaaatttaaaaaatcaattttaaatgttttaaaaacatatagcttagggattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattcaaaagtatatttctaaaagttttccccagaggccagatacagtggctcatgcctataatcccagcactttgggagcctgagataggagtattgcttgaggctaggagtttgagaccaacctggcaacatggcaagaccctatctctacaaaaattttaaaacttagccaggtgtggtagtgcacctgtagtcccagctagtcagtaggctgaggtgggagtattgcttgaggctgcagtgaggtgtgatcacgccactgcactccggcctgacagaatgagatcctgtctcaaaaagaaaattccccagaagaagaattctaattttatcaagctgaattaaagtttgagagtcttttttttaaaatcttactgtgtcaaaagaggcattatgttgcttgtgtgatatagtgaatagtgtccctccaaatttcatgtacacctggaatgtcacaatgtgacttaacagtagccacccctcacccccgcccttatctgtggtggatacatttgcaagatccccagtggatgcctgaaaccgcagatagtactgaaccttatatatactgtttgttttcctatgcatacatatccctatgataaagtttatgaatttggcacttaacagcagaactaataagatgaaagagttgtaacaatatactctaataaaagttatttaaaatgtatgtattgttatctgtaattttgcatttaatatttttggaccatggtttaatctgggtaactgaaaacacagaaagtgaaatcatgggccgggc

SEQ ID NO: 322440 - DNA, 4421 bp, Homo sapiens
gtttgagaccatcctgggcaacatagcaagacccagtctctacaacaaaaatttttttttaattagttgggactaatttaaattttttttaaatagtcccagctactcaggaggcttaaggcaggaggattgcttgagcccaggagtttgagaatgcagtgagctatgatctgcaccccagcctgggcaacagagcaagatcccatctcaaaaataagaagaagaaaatttgattaacagtattcaatggctggaatgattaaattgtaatcagaacagcagagctacgtaagcttaaaaagaagatggaaaaggcatttttgtcatgatgattgatctctaaccttatatattgcaaagtaaatatggttttctttttaaaattttgtttgtagcactggacaagacactgtttccaatcctacttatatgaaccagaactctaacctacagtcagctactggtacaactgcttacacacagcaaatggggatgtctgtggatatgtcatcttatcagaacactacttccaatttgcctcaactggcaggctttccggtgacagttccagctcatccagttgcacagcagcacacaaattaccatcagcagcctctcctttagaaacaaatcaagcattttcttgaaagccttcataagtgtattattcagtccttgtgataccaacctgaaaatattaaaacttttttccctctcaactcaaaaggaccatgaataaataaagcacaaaaacctctcttattctacaaggccataaaaggttttttttttttttttttttcagtccagtttgtttgaagtcaatcttttcatcagaggcagcttaaagatgctttcagttagttttgtcttactttcagatttctctacataaatctagatactcattaagtagccttatgacaaacagtatgtcaaaagtatctcatacttataaacagtatgagataggaggattaaaatattattttaaagaaaccactgtttccccctaaaatgtcataagagcactgaagaacttgaaatatttttttcagagtttctcacacactttaaaagtctaacttttttgtgtgtaagcatttagcttgccagcatatttctttttggctccttaaattgcggttgtgtttgcagtattgtcacttttgctctcactgttatgttgaataataattagcatataattgtctacagaagcaagagcaatctggaaggaacaaaaatgttttctgtgattaacagtgaagaccttgtaaatgcagatgtgtgataaagcatttagtcagtcccccaaacagtcatgccaactgtgaaggaatgtcccacaaaacatttccattccctgaggaaaaacattttctttcctacatgtatctctggtatttagaattgtcactaataaccttttcaagtgattttggctattctctaatgaagatatggtccatttgtttttcttcctgcaatgtggtgtgcagagatgctgcatatcctttttatgggattgcgtgtgaatttgaaccatgagacattcctaataatttgttgtgagatataccaagcatggatgataagtgtgtttttagtggtgtgttgtttttttaaagaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcctgcattttgagttagtttatagtgctaatagattctatataactgtgagagtttggtagtaaaccagtagggattgttttctctcctaaaaatttgcacactacttcattgtctaccaactttttacatattggaaaatagaaattgcaaatacatacatgtatggaaacatattcagattgggaaaaacaatggacattagtttttaaaaagttacgtggaagcaagatttctatatttgtttttttaaaggaagcagtcattctttctactaaatccatttcaagctagttctctgaaaattttgccatttatctacagaaatttgattataaatatgttcctttttcaaagaaactttattctagaacaaaatagtctatatggtacttgatctacatttaagtggaaaaattagcagtatttgaaagctcagtttatgtcattgtcttaacttcagatacaaataactgaacagaaagttttaacctttaatatctcatgttctgttttttattcagtattttcctttatgttaattcaattatatacttctgaatggcaccttactttttggaaacaaatcttctgttatttacaaaataataatttttaaaaaacatttaaaaaaaatccaaagctgctctcgataatagtcaacatttgcatatatatggaatttcttactttttttctcccaaactctatttaataaacttattttaatgtttgtgtatttcatgtataattgtgatctcaattataaaagtttaattcagcatgtctttgagccaatataattactgcacacccactaaattgggatcagccattataaataatgtagttttagaataataaaacatgacacatatatatatatataaatatatagtatatattggcacatcggtgaaagtttatatgtgcagaagtttttttctttctcaagttaaaaattattttttgccatatgtaattttgtgttgcaggctgtcgagagataaaaatgattttaaatctgtgtactgatgattctttcggtgttaagaaacacagggttgtgtacttccctttttatgggcttatggattctatttatattaagacctgtttataattgttttctgccaaagggaattgtctaacttcagatttctacattgggttcatacttactgttttatatcagaaataaaaaaatagcttctgctttttcatatgaaatcttggtacatcagaaagaattcctgaaaatttataatagaatgaattttattaatgcagaaaaataccccagggtgttaaaatatatgaagtgtgggatatattcttatagtttgtaaaatgtagtcaaccaatactgtcttctaatttggtaatttatttataaaattacttaaacattaggtaattatatttgttaggatttgaaattatttgtagttaaattgtcatgctgtttgaaataattgatacttgtctacgtaatacattttactgtatgttttgaagatggttataatttcactttcaaaatttaaaaaatcaattttaaatgttttaaaaacatatagcttagggattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattcaaaagtatatttctaaaagttttccccagaggccagatacagtggctcatgcctataatcccagcactttgggagcctgagataggagtattgcttgaggctaggagtttgagaccaacctggcaacatggcaagaccctatctctacaaaaattttaaaacttagccaggtgtggtagtgcacctgtagtcccagctagtcagtaggctgaggtgggagtattgcttgaggctgcagtgaggtgtgatcacgccactgcactccggcctgacagaatgagatcctgtctcaaaaagaaaattccccagaagaagaattctaattttatcaagctgaattaaagtttgagagtcttttttttaaaatcttactgtgtcaaaagaggcattatgttgcttgtgtgatatagtgaatagtgtccctccaaatttcatgtacacctggaatgtcacaatgtgacttaacagtagccacccctcacccccgcccttatctgtggtggatacatttgcaagatccccagtggatgcctgaaaccgcagatagtactgaaccttatatatactgtttgttttcctatgcatacatatccctatgataaagtttatgaatttggcacttaacagcagaactaataagatgaaagagttgtaacaatatactctaataaaagttatttaaaatgtatgtattgttatctgtaattttgcatttaatatttttggaccatggtttaatctgggtaactgaaaacacagaaagtgaaatcatgggccgggc

SEQ ID NO: 322441 - DNA, 4107 bp, Homo sapiens
ggctccgaaggtccccggcttcgtggctagccggggtcctagcgctggaaaggtggccgtagcggccgcctgacccctacaaaagtctgggacaggggcagcgacaaaggccttgggaggacgcccatggtcggagggatctcgccccgggagaaaagttgggacaggagcgcgggatcgaagggtggactccgagccggcctgtcagcgaagagcgttgcaggtgcggtggcggaagtgcagggacggaggccgaagcggagcggtctagggagccgcggccgcgggtcacccggcgggtagcagttgctgagtgtcagctagacagcagcgactagggctcgggcgccggcgagatgcctttgttcaccgccaaccccttcgagcaagacgtggaaaaagccacgaatgagtacaacactacagaagattggagtcttattatggacatatgtgacaaagttggaagtactcctaatggagcgaaagattgcctaaaagccataatgaaaagggtaaatcataaggttccacatgttgctctgcaagcactaactcttcttggggcttgtgtggcaaactgtggaaagatatttcatttagaagtatgttcccgtgatgtcaaaagtatctcatacttataaacagtatgagataggaggattaaaatattattttaaagaaaccactgtttccccctaaaatgtcataagagcactgaagaacttgaaatatttttttcagagtttctcacacactttaaaagtctaacttttttgtgtgtaagcatttagcttgccagcatatttctttttggctccttaaattgcggttgtgtttgcagtattgtcacttttgctctcactgttatgttgaataataattagcatataattgtctacagaagcaagagcaatctggaaggaacaaaaatgttttctgtgattaacagtgaagaccttgtaaatgcagatgtgtgataaagcatttagtcagtcccccaaacagtcatgccaactgtgaaggaatgtcccacaaaacatttccattccctgaggaaaaacattttctttcctacatgtatctctggtatttagaattgtcactaataaccttttcaagtgattttggctattctctaatgaagatatggtccatttgtttttcttcctgcaatgtggtgtgcagagatgctgcatatcctttttatgggattgcgtgtgaatttgaaccatgagacattcctaataatttgttgtgagatataccaagcatggatgataagtgtgtttttagtggtgtgttgtttttttaaagaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcctgcattttgagttagtttatagtgctaatagattctatataactgtgagagtttggtagtaaaccagtagggattgttttctctcctaaaaatttgcacactacttcattgtctaccaactttttacatattggaaaatagaaattgcaaatacatacatgtatggaaacatattcagattgggaaaaacaatggacattagtttttaaaaagttacgtggaagcaagatttctatatttgtttttttaaaggaagcagtcattctttctactaaatccatttcaagctagttctctgaaaattttgccatttatctacagaaatttgattataaatatgttcctttttcaaagaaactttattctagaacaaaatagtctatatggtacttgatctacatttaagtggaaaaattagcagtatttgaaagctcagtttatgtcattgtcttaacttcagatacaaataactgaacagaaagttttaacctttaatatctcatgttctgttttttattcagtattttcctttatgttaattcaattatatacttctgaatggcaccttactttttggaaacaaatcttctgttatttacaaaataataatttttaaaaaacatttaaaaaaaatccaaagctgctctcgataatagtcaacatttgcatatatatggaatttcttactttttttctcccaaactctatttaataaacttattttaatgtttgtgtatttcatgtataattgtgatctcaattataaaagtttaattcagcatgtctttgagccaatataattactgcacacccactaaattgggatcagccattataaataatgtagttttagaataataaaacatgacacatatatatatatataaatatatagtatatattggcacatcggtgaaagtttatatgtgcagaagtttttttctttctcaagttaaaaattattttttgccatatgtaattttgtgttgcaggctgtcgagagataaaaatgattttaaatctgtgtactgatgattctttcggtgttaagaaacacagggttgtgtacttccctttttatgggcttatggattctatttatattaagacctgtttataattgttttctgccaaagggaattgtctaacttcagatttctacattgggttcatacttactgttttatatcagaaataaaaaaatagcttctgctttttcatatgaaatcttggtacatcagaaagaattcctgaaaatttataatagaatgaattttattaatgcagaaaaataccccagggtgttaaaatatatgaagtgtgggatatattcttatagtttgtaaaatgtagtcaaccaatactgtcttctaatttggtaatttatttataaaattacttaaacattaggtaattatatttgttaggatttgaaattatttgtagttaaattgtcatgctgtttgaaataattgatacttgtctacgtaatacattttactgtatgttttgaagatggttataatttcactttcaaaatttaaaaaatcaattttaaatgttttaaaaacatatagcttagggattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattcaaaagtatatttctaaaagttttccccagaggccagatacagtggctcatgcctataatcccagcactttgggagcctgagataggagtattgcttgaggctaggagtttgagaccaacctggcaacatggcaagaccctatctctacaaaaattttaaaacttagccaggtgtggtagtgcacctgtagtcccagctagtcagtaggctgaggtgggagtattgcttgaggctgcagtgaggtgtgatcacgccactgcactccggcctgacagaatgagatcctgtctcaaaaagaaaattccccagaagaagaattctaattttatcaagctgaattaaagtttgagagtcttttttttaaaatcttactgtgtcaaaagaggcattatgttgcttgtgtgatatagtgaatagtgtccctccaaatttcatgtacacctggaatgtcacaatgtgacttaacagtagccacccctcacccccgcccttatctgtggtggatacatttgcaagatccccagtggatgcctgaaaccgcagatagtactgaaccttatatatactgtttgttttcctatgcatacatatccctatgataaagtttatgaatttggcacttaacagcagaactaataagatgaaagagttgtaacaatatactctaataaaagttatttaaaatgtatgtattgttatctgtaattttgcatttaatatttttggaccatggtttaatctgggtaactgaaaacacagaaagtgaaatcatgggccgggc

SEQ ID NO: 322442 - DNA, 826 bp, Homo sapiens
gcaggtgcggtggcggaagtgcagggacggaggccgaagcggagcggtctagggagccgcggccgcgggtcacccggcgggtagcagttgctgagtgtcagctagacagcagcgactagggctcgggcgccggcgagatgcctttgttcaccgccaaccccttcgagcaagacgtgggtgagtgctgtgcccggtcctggactgctgtgtgcctggccctggactgctgtttgtccggctagaaagtgggcggtagcgactccggggactaggaagcaaagcgaagggaggggaggggcggtgccgcccgctccttcgacgttgggatttttctggggcaacctcggcgcgtcgctagcggtctggggagtgcttcctgccgcctgagtttggggaccctcaaagggccgttctccttgccaagcgtaggatttgggaagagcctagggctcgctggagactggactgattaagtagttgtggagttggtgattaaaaacttcctgctcgttcgacagctggttacctccgtctttgccccatcgttttctgaagatgatgcagcagtggagaccctgctgtctagagaagcccaacactagacacttgacacctagacaaccgcattgaataggaagaacttacttccccattatttatattactcatgcattcaatccctgatagggtagctttaagatttattacaattgtaaaggtgttgctcttcatccccggattgcaaagattgcgcgggtgctaggagatgttcggttttagagtatgaaaaggaaatctccagtctcaaaacactccagaacaacaa

SEQ ID NO: 322443 - DNA, 1614 bp, Homo sapiens
ggctccgaaggtccccggcttcgtggctagccggggtcctagcgctggaaaggtggccgtagcggccgcctgacccctacaaaagtctgggacaggggcagcgacaaaggccttgggaggacgcccatggtcggagggatctcgccccgggagaaaagttgggacaggagcgcgggatcgaagggtggactccgagccggcctgtcagcgaagagcgttgcaggtgcggtggcggaagtgcagggacggaggccgaagcggagcggtctagggagccgcggccgcgggtcacccggcgggtagcagttgctgagtgtcagctagacagcagcgactagggctcgggcgccggcgagatgcctttgttcaccgccaaccccttcgagcaagacgtggaaaaagccacgaatgagtacaacactacagaagattggagtcttattatggacatatgtgacaaagttggaagtactcctaatggagcgaaagattgcctaaaagccataatgaaaagggtaaatcataaggttccacatgttgctctgcaagcactaactcttcttggggcttgtgtggcaaactgtggaaagatatttcatttagaagtatgttcccgtgattttgcaacagaagtacgtgctgtgattaaaaataaggcacatcctaaagtatgtgaaaaactgaaatctttaatggtggagtggtcagaagaatttcagaaggaccctcagtttagtctgatatctgcaactattaaatctatgaaagaagaaggaattacttttcctccagcaggttctcagactgtctcagctgctgccaagaatggtacgtcatcgaacaaaaacaaagaggatgaagacatagctaaagctattgaattatcgctgcaagaacagaaacagcaacacacagaaacaaaatccttatatccatcttcagaaattcagttaaataataaggttgcacggaaagtgagagctttatatgattttgaagctgttgaggacaatgaactcacctttaaacatggtgaaataattattgttttggatgacagtgatgccaattggtggaaaggagaaaatcacagaggaataggacttttcccatccaattttgtaacaactaatttaaacatagagactgaggcagcggctgtggacaaattgaatgtaattgatgatgatgtggaggaaattaagaaatcagagcctgagcctgtttatatagatgaggataagatggatagagccctgcaggtacttcagagtatagatccaacagattcaaaaccagactcccaagaccttttggatttagaagatatctgccaacagatgggtccaatgatagatgaaaaacttgaagaaattgataggtgagatttttcgtgcaaggaataaaaagtatagttttggggggttcacttgtgttttggcaaacagtaaagtagggaaagtttttgtggaactgtacaattcatggaaattgtttttcagtttcccaggcttttaacaaatttatagcaaggtggtgctttttatcttgtttttgtttttctaaaaaacaagctctgacaagttttattaaataaaaattttgcatggctta

SEQ ID NO: 322444 - DNA, 5710 bp, Homo sapiens
ggctccgaaggtccccggcttcgtggctagccggggtcctagcgctggaaaggtggccgtagcggccgcctgacccctacaaaagtctgggacaggggcagcgacaaaggccttgggaggacgcccatggtcggagggatctcgccccgggagaaaagttgggacaggagcgcgggatcgaagggtggactccgagccggcctgtcagcgaagagcgttgcaggtgcggtggcggaagtgcagggacggaggccgaagcggagcggtctagggagccgcggccgcgggtcacccggcgggtagcagttgctgagtgtcagctagacagcagcgactagggctcgggcgccggcgagatgcctttgttcaccgccaaccccttcgagcaagacgtggaaaaagccacgaatgagtacaacactacagaagattggagtcttattatggacatatgtgacaaagttggaagtactcctaatggagcgaaagattgcctaaaagccataatgaaaagggtaaatcataaggttccacatgttgctctgcaagcactaactcttcttggggcttgtgtggcaaactgtggaaagatatttcatttagaagtatgttcccgtgattttgcaacagaagtacgtgctgtgattaaaaataaggcacatcctaaagtatgtgaaaaactgaaatctttaatggtggagtggtcagaagaatttcagaaggaccctcagtttagtctgatatctgcaactattaaatctatgaaagaagaaggaattacttttcctccagcaggttctcagactgtctcagctgctgccaagaatggtacgtcatcgaacaaaaacaaagaggatgaagacatagctaaagctattgaattatcgctgcaagaacagaaacagcaacacacagaaacaaaatccttatatccatcttcagaaattcagttaaataataaggttgcacggaaagtgagagctttatatgattttgaagctgttgaggacaatgaactcacctttaaacatggtgaaataattattgttttggatgacagtgatgccaattggtggaaaggagaaaatcacagaggaataggacttttcccatccaattttgtaacaactaatttaaacatagagactgaggcagcggctgtggacaaattgaatgtaattgatgatgatgtggaggaaattaagaaatcagagcctgagcctgtttatatagatgaggataagatggatagagccctgcaggtacttcagagtatagatccaacagattcaaaaccagactcccaagaccttttggatttagaagatatctgccaacagatgggtccaatgatagatgaaaaacttgaagaaattgataggaagcattcagaattgtctgaattgaatgttaaagtcctggaagctctggaactatataacaaattggtgaatgaagcaccagtgtactcagtctattcaaagctccaccctccagcacattacccacctgcatcatctggggttccaatgcagacatatccagttcaatcacatggtggaaactatatgggtcagagcattcaccaagtaactgttgcccaaagctatagcctaggacccgatcaaattggtccactgagatctctgcctccaaatgtgaattcctcagtgacagcacagcctgctcaaacttcatatttaagcactggacaagacactgtttccaatcctacttatatgaaccagaactctaacctacagtcagctactggtacaactgcttacacacagcaaatggggatgtctgtggatatgtcatcttatcagaacactacttccaatttgcctcaactggcaggctttccggtgacagttccagctcatccagttgcacagcagcacacaaattaccatcagcagcctctcctttagaaacaaatcaagcattttcttgaaagccttcataagtgtattattcagtccttgtgataccaacctgaaaatattaaaacttttttccctctcaactcaaaaggaccatgaataaataaagcacaaaaacctctcttattctacaaggccataaaaggttttttttttttttttttttcagtccagtttgtttgaagtcaatcttttcatcagaggcagcttaaagatgctttcagttagttttgtcttactttcagatttctctacataaatctagatactcattaatgtcaaaagtatctcatacttataaacagtatgagataggaggattaaaatattattttaaagaaaccactgtttccccctaaaatgtcataagagcactgaagaacttgaaatatttttttcagagtttctcacacactttaaaagtctaacttttttgtgtgtaagcatttagcttgccagcatatttctttttggctccttaaattgcggttgtgtttgcagtattgtcacttttgctctcactgttatgttgaataataattagcatataattgtctacagaagcaagagcaatctggaaggaacaaaaatgttttctgtgattaacagtgaagaccttgtaaatgcagatgtgtgataaagcatttagtcagtcccccaaacagtcatgccaactgtgaaggaatgtcccacaaaacatttccattccctgaggaaaaacattttctttcctacatgtatctctggtatttagaattgtcactaataaccttttcaagtgattttggctattctctaatgaagatatggtccatttgtttttcttcctgcaatgtggtgtgcagagatgctgcatatcctttttatgggattgcgtgtgaatttgaaccatgagacattcctaataatttgttgtgagatataccaagcatggatgataagtgtgtttttagtggtgtgttgtttttttaaagaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcctgcattttgagttagtttatagtgctaatagattctatataactgtgagagtttggtagtaaaccagtagggattgttttctctcctaaaaatttgcacactacttcattgtctaccaactttttacatattggaaaatagaaattgcaaatacatacatgtatggaaacatattcagattgggaaaaacaatggacattagtttttaaaaagttacgtggaagcaagatttctatatttgtttttttaaaggaagcagtcattctttctactaaatccatttcaagctagttctctgaaaattttgccatttatctacagaaatttgattataaatatgttcctttttcaaagaaactttattctagaacaaaatagtctatatggtacttgatctacatttaagtggaaaaattagcagtatttgaaagctcagtttatgtcattgtcttaacttcagatacaaataactgaacagaaagttttaacctttaatatctcatgttctgttttttattcagtattttcctttatgttaattcaattatatacttctgaatggcaccttactttttggaaacaaatcttctgttatttacaaaataataatttttaaaaaacatttaaaaaaaatccaaagctgctctcgataatagtcaacatttgcatatatatggaatttcttactttttttctcccaaactctatttaataaacttattttaatgtttgtgtatttcatgtataattgtgatctcaattataaaagtttaattcagcatgtctttgagccaatataattactgcacacccactaaattgggatcagccattataaataatgtagttttagaataataaaacatgacacatatatatatatataaatatatagtatatattggcacatcggtgaaagtttatatgtgcagaagtttttttctttctcaagttaaaaattattttttgccatatgtaattttgtgttgcaggctgtcgagagataaaaatgattttaaatctgtgtactgatgattctttcggtgttaagaaacacagggttgtgtacttccctttttatgggcttatggattctatttatattaagacctgtttataattgttttctgccaaagggaattgtctaacttcagatttctacattgggttcatacttactgttttatatcagaaataaaaaaatagcttctgctttttcatatgaaatcttggtacatcagaaagaattcctgaaaatttataatagaatgaattttattaatgcagaaaaataccccagggtgttaaaatatatgaagtgtgggatatattcttatagtttgtaaaatgtagtcaaccaatactgtcttctaatttggtaatttatttataaaattacttaaacattaggtaattatatttgttaggatttgaaattatttgtagttaaattgtcatgctgtttgaaataattgatacttgtctacgtaatacattttactgtatgttttgaagatggttataatttcactttcaaaatttaaaaaatcaattttaaatgttttaaaaacatatagcttagggattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattcaaaagtatatttctaaaagttttccccagaggccagatacagtggctcatgcctataatcccagcactttgggagcctgagataggagtattgcttgaggctaggagtttgagaccaacctggcaacatggcaagaccctatctctacaaaaattttaaaacttagccaggtgtggtagtgcacctgtagtcccagctagtcagtaggctgaggtgggagtattgcttgaggctgcagtgaggtgtgatcacgccactgcactccggcctgacagaatgagatcctgtctcaaaaagaaaattccccagaagaagaattctaattttatcaagctgaattaaagtttgagagtcttttttttaaaatcttactgtgtcaaaagaggcattatgttgcttgtgtgatatagtgaatagtgtccctccaaatttcatgtacacctggaatgtcacaatgtgacttaacagtagccacccctcacccccgcccttatctgtggtggatacatttgcaagatccccagtggatgcctgaaaccgcagatagtactgaaccttatatatactgtttgttttcctatgcatacatatccctatgataaagtttatgaatttggcacttaacagcagaactaataagatgaaagagttgtaacaatatactctaataaaagttatttaaaatgtatgtattgttatctgtaattttgcatttaatatttttggaccatggtttaatctgggtaactgaaaacacagaaagtgaaatcatgggccgggc

SEQ ID NO: 322445 - DNA, 5760 bp, Homo sapiens
ggctccgaaggtccccggcttcgtggctagccggggtcctagcgctggaaaggtggccgtagcggccgcctgacccctacaaaagtctgggacaggggcagcgacaaaggccttgggaggacgcccatggtcggagggatctcgccccgggagaaaagttgggacaggagcgcgggatcgaagggtggactccgagccggcctgtcagcgaagagcgttgcaggtgcggtggcggaagtgcagggacggaggccgaagcggagcggtctagggagccgcggccgcgggtcacccggcgggtagcagttgctgagtgtcagctagacagcagcgactagggctcgggcgccggcgagatgcctttgttcaccgccaaccccttcgagcaagacgtggaaaaagccacgaatgagtacaacactacagaagattggagtcttattatggacatatgtgacaaagttggaagtactcctaatggagcgaaagattgcctaaaagccataatgaaaagggtaaatcataaggttccacatgttgctctgcaagcactaactcttcttggggcttgtgtggcaaactgtggaaagatatttcatttagaagtatgttcccgtgattttgcaacagaagtacgtgctgtgattaaaaataaggcacatcctaaagtatgtgaaaaactgaaatctttaatggtggagtggtcagaagaatttcagaaggaccctcagtttagtctgatatctgcaactattaaatctatgaaagaagaaggaattacttttcctccagcaggttctcagggctgggcgcggtggctcacgcctgtaatcccagcactttgggaggccgaagtgggcagatcatgaggtcaagagatcgagaccagcctgaccaacaagctattgaattatcgctgcaagaacagaaacagcaacacacagaaacaaaatccttatatccatcttcagaaattcagttaaataataaggttgcacggaaagtgagagctttatatgattttgaagctgttgaggacaatgaactcacctttaaacatggtgaaataattattgttttggatgacagtgatgccaattggtggaaaggagaaaatcacagaggaataggacttttcccatccaattttgtaacaactaatttaaacatagagactgaggcagcggctgtggacaaattgaatgtaattgatgatgatgtggaggaaattaagaaatcagagcctgagcctgtttatatagatgaggataagatggatagagccctgcaggtacttcagagtatagatccaacagattcaaaaccagactcccaagaccttttggatttagaagatatctgccaacagatgggtccaatgatagatgaaaaacttgaagaaattgataggaagcattcagaattgtctgaattgaatgttaaagtcctggaagctctggaactatataacaaattggtgaatgaagcaccagtgtactcagtctattcaaagctccaccctccagcacattacccacctgcatcatctggggttccaatgcagacatatccagttcaatcacatggtggaaactatatgggtcagagcattcaccaagtaactgttgcccaaagctatagcctaggacccgatcaaattggtccactgagatctctgcctccaaatgtgaattcctcagtgacagcacagcctgctcaaacttcatatttaagcactggacaagacactgtttccaatcctacttatatgaaccagaactctaacctacagtcagctactggtacaactgcttacacacagcaaatggggatgtctgtggatatgtcatcttatcagaacactacttccaatttgcctcaactggcaggctttccggtgacagttccagctcatccagttgcacagcagcacacaaattaccatcagcagcctctcctttagaaacaaatcaagcattttcttgaaagccttcataagtgtattattcagtccttgtgataccaacctgaaaatattaaaacttttttccctctcaactcaaaaggaccatgaataaataaagcacaaaaacctctcttattctacaaggccataaaaggttttttttttttttttttttcagtccagtttgtttgaagtcaatcttttcatcagaggcagcttaaagatgctttcagttagttttgtcttactttcagatttctctacataaatctagatactcattaagtagccttatgacaaacagtatgtcaaaagtatctcatacttataaacagtatgagataggaggattaaaatattattttaaagaaaccactgtttccccctaaaatgtcataagagcactgaagaacttgaaatatttttttcagagtttctcacacactttaaaagtctaacttttttgtgtgtaagcatttagcttgccagcatatttctttttggctccttaaattgcggttgtgtttgcagtattgtcacttttgctctcactgttatgttgaataataattagcatataattgtctacagaagcaagagcaatctggaaggaacaaaaatgttttctgtgattaacagtgaagaccttgtaaatgcagatgtgtgataaagcatttagtcagtcccccaaacagtcatgccaactgtgaaggaatgtcccacaaaacatttccattccctgaggaaaaacattttctttcctacatgtatctctggtatttagaattgtcactaataaccttttcaagtgattttggctattctctaatgaagatatggtccatttgtttttcttcctgcaatgtggtgtgcagagatgctgcatatcctttttatgggattgcgtgtgaatttgaaccatgagacattcctaataatttgttgtgagatataccaagcatggatgataagtgtgtttttagtggtgtgttgtttttttaaagaggtgattcaagtaccgttgctaagctgtcaacataccaagctgttgaaaaaattgaccatttctttcagaagtaattctcagcctgtggaataatagcaggtgaagacttcatagaaggcgacagattgatagggaggctattgaagcagtttttctgaagcctgcattttgagttagtttatagtgctaatagattctatataactgtgagagtttggtagtaaaccagtagggattgttttctctcctaaaaatttgcacactacttcattgtctaccaactttttacatattggaaaatagaaattgcaaatacatacatgtatggaaacatattcagattgggaaaaacaatggacattagtttttaaaaagttacgtggaagcaagatttctatatttgtttttttaaaggaagcagtcattctttctactaaatccatttcaagctagttctctgaaaattttgccatttatctacagaaatttgattataaatatgttcctttttcaaagaaactttattctagaacaaaatagtctatatggtacttgatctacatttaagtggaaaaattagcagtatttgaaagctcagtttatgtcattgtcttaacttcagatacaaataactgaacagaaagttttaacctttaatatctcatgttctgttttttattcagtattttcctttatgttaattcaattatatacttctgaatggcaccttactttttggaaacaaatcttctgttatttacaaaataataatttttaaaaaacatttaaaaaaaatccaaagctgctctcgataatagtcaacatttgcatatatatggaatttcttactttttttctcccaaactctatttaataaacttattttaatgtttgtgtatttcatgtataattgtgatctcaattataaaagtttaattcagcatgtctttgagccaatataattactgcacacccactaaattgggatcagccattataaataatgtagttttagaataataaaacatgacacatatatatatatataaatatatagtatatattggcacatcggtgaaagtttatatgtgcagaagtttttttctttctcaagttaaaaattattttttgccatatgtaattttgtgttgcaggctgtcgagagataaaaatgattttaaatctgtgtactgatgattctttcggtgttaagaaacacagggttgtgtacttccctttttatgggcttatggattctatttatattaagacctgtttataattgttttctgccaaagggaattgtctaacttcagatttctacattgggttcatacttactgttttatatcagaaataaaaaaatagcttctgctttttcatatgaaatcttggtacatcagaaagaattcctgaaaatttataatagaatgaattttattaatgcagaaaaataccccagggtgttaaaatatatgaagtgtgggatatattcttatagtttgtaaaatgtagtcaaccaatactgtcttctaatttggtaatttatttataaaattacttaaacattaggtaattatatttgttaggatttgaaattatttgtagttaaattgtcatgctgtttgaaataattgatacttgtctacgtaatacattttactgtatgttttgaagatggttataatttcactttcaaaatttaaaaaatcaattttaaatgttttaaaaacatatagcttagggattttttttaaaaaggttttcttagtaaaaacataaatttaaaagcccctgagttctaggagagggcttattgaattgctataagaaagctggagttactttgataagtaataaattataaatagcactgatctataatgctttatttctatcggaaggtactttttcttctttcatcatcagttttagccagttagtaaatgggaatactcagttttagggatttgatttttgtttggtttaattttctttcaaaaattcaaaagtatatttctaaaagttttccccagaggccagatacagtggctcatgcctataatcccagcactttgggagcctgagataggagtattgcttgaggctaggagtttgagaccaacctggcaacatggcaagaccctatctctacaaaaattttaaaacttagccaggtgtggtagtgcacctgtagtcccagctagtcagtaggctgaggtgggagtattgcttgaggctgcagtgaggtgtgatcacgccactgcactccggcctgacagaatgagatcctgtctcaaaaagaaaattccccagaagaagaattctaattttatcaagctgaattaaagtttgagagtcttttttttaaaatcttactgtgtcaaaagaggcattatgttgcttgtgtgatatagtgaatagtgtccctccaaatttcatgtacacctggaatgtcacaatgtgacttaacagtagccacccctcacccccgcccttatctgtggtggatacatttgcaagatccccagtggatgcctgaaaccgcagatagtactgaaccttatatatactgtttgttttcctatgcatacatatccctatgataaagtttatgaatttggcacttaacagcagaactaataagatgaaagagttgtaacaatatactctaataaaagttatttaaaatgtatgtattgttatctgtaattttgcatttaatatttttggaccatggtttaatctgggtaactgaaaacacagaaagtgaaatcatgggccgggc

SEQ ID NO: 322446 - DNA, 1213 bp, Homo sapiens
ggctccgaaggtccccggcttcgtggctagccggggtcctagcgctggaaaggtggccgtagcggccgcctgacccctacaaaagtctgggacaggggcagcgacaaaggccttgggaggacgcccatggtcggagggatctcgccccgggagaaaagttgggacaggagcgcgggatcgaagggtggactccgagccggcctgtcagcgaagagcgttgcaggtgcggtggcggaagtgcagggacggaggccgaagcggagcggtctagggagccgcggccgcgggtcacccggcgggtagcagttgctgagtgtcagctagacagcagcgactagggctcgggcgccggcgagatgcctttgttcaccgccaaccccttcgagcaagacgtggaaaaagccacgaatgagtacaacactacagaagattggagtcttattatggacatatgtgacaaagttggaagtactcctaatggagcgaaagattgcctaaaagccataatgaaaagggtaaatcataaggttccacatgttgctctgcaagcactaactcttcttggggcttgtgtggcaaactgtggaaagatatttcatttagaagtatgttcccgtgattttgcaacagaagtacgtgctgtgattaaaaataaggcacatcctaaagtatgtgaaaaactgaaatctttaatggtggagtggtcagaagaatttcagaaggaccctcagtttagtctgatatctgcaactattaaatctatgaaagaagaaggaattacttttcctccagcaggttctcagactgtctcagctgctgccaagaatggtacgtcatcgaacaaaaacaaagaggatgaagacatagctaaagctattgaattatcgctgcaagaacagaaacagcaacacacagaaacaaaatccttatatccatcttcagaaattcagttaaataataaggttgcacggaaagtgagagctttatatgattttgaagctgttgaggacaatgaactcacctttaaacatggtgaaataattattgttttggatgacaggtaagttttaaatctttatgggaaggtttaaagtgtaatgcccttaatttagaatccagagtattcagttctttgacttttagtgtatttaaatcataatagaaccatttcataccttgttttttctaaaataaaagttaggcatgtaatgtg

SEQ ID NO: 322447 - DNA, 4219 bp, Homo sapiens
gctactgccacctcgcgctcggaggcgtcacagaacgtgctcttctctcccctcccccctcccgctctccccctcctccccctcccgctccaagattcgccgccgccgccgccgcagccgcaggagtagccgccgccggagccgcgcgcagccatggccgagaaccccagcttggagaaccaccgcatcaagagcttcaagaacaagggccgcgatgtggaaacaatgcgaagacatagaaatgaagtgacagtggaactgcggaagaacaaaagagatgaacacttattgaaaaagagaaatgttccccaagaagaaagtctagaagattcagatgttgatgctgattttaaagcacaaaatgtaaccctagaagctatattgcagaatgccacaagtgataacccagtggtccaattgagtgctgtccaggcagcaagaaaactgttatccagtgacagaaatccaccgattgatgacttaataaaatctgggattttaccaattctagtcaaatgtctagaaagggatgataatccttcattacagtttgaagctgcttgggcattaactaacatagcatcaggaacttctgcacagactcaagctgttgtgcagtctaatgcagtacctctttttctgagacttcttcgttcaccacatcagaatgtttgtgaacaagcagtatgggctttgggaaacattataggtgatggtcctcaatgtagagattatgtcatatcactgggagttgtcaaacctcttctgtccttcatcagtccctccatccccatcaccttccttcggaacgtcacatgggtcattgtcaatctctgcaggaataaggatcccccaccgcctatggagacagttcaggagattttgccagctttatgtgtcctcatataccatacagatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagggggactttggaacacaaaaagaagctgcttgggcaatcagcaacttaacaataagtggcagaaaagatcaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtttggagaaaattgaagttttacagcaacatgaaaatgaagacatatataaattagcatttgaaatcatagatcagtatttctctggtgatgatattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagttttaaaaaaaaaaaaaactacttcatctaccagtaattgatgtgtttattatctgcctcagaagccagggttggaggaagaactttagatatggatattaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgcttttggtaaattgtctgacccagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagtttcttctggactttccttacttaactgacagttaccttttaaaatttgcacacattatgattaaaattgggcctctactgtgatgattcctatttcctctcatgttttaaagtgcaaactaacatttaagtgaacattagcatcaagtagtgcagacacttgtatgcatttccttgattcaatttgtgaccttaccagttttgaattggaattgcaccatttcgtagataaaggaaactaagtatattgctgcacttttaagttttcaaaacagtgtttaaaaattgcattgttatttttttttaaactcagtttaaaaagactaaaacgttctttcaaaagaggcatctaaatgtgttcctaattttgtatatgggcttaggttttgtaaccaataaaaaaagctgctatcaaatatgataaaacattgaaaacttaaaaaaaa

SEQ ID NO: 322448 - DNA, 4186 bp, Homo sapiens
gctactgccacctcgcgctcggaggcgtcacagaacgtgctcttctctcccctcccccctcccgctctccccctcctccccctcccgctccaagattcgccgccgccgccgccgcagccgcaggagtagccgccgccggagccgcgcgcagccatggccgagaaccccagcttggagaaccaccgcatcaagagcttcaagaacaagggccgcgatgtggaaacaatgcgaagacatagaaatgaagtgacagtggaactgcggaagaacaaaagagatgaacacttattgaaaaagagaaatgttccccaagaagaaagtctagaagattcagatgttgatgctgattttaaagcacaaaatgtaaccctagaagctatattgcagaatgccacaagtgataacccagtggtccaattgagtgctgtccaggcagcaagaaaactgttatccagtgacagaaatccaccgattgatgacttaataaaatctgggattttaccaattctagtcaaatgtctagaaagggatgataatccttcattacagtttgaagctgcttgggcattaactaacatagcatcaggaacttctgcacagactcaagctgttgtgcagtctaatgcagtacctctttttctgagacttcttcgttcaccacatcagaatgtttgtgaacaagcagtatgggctttgggaaacattataggtgatggtcctcaatgtagagattatgtcatatcactgggagttgtcaaacctcttctgtccttcatcagtccctccatccccatcaccttccttcggaacgtcacatgggtcattgtcaatctctgcaggaataaggatcccccaccgcctatggagacagttcaggagattttgccagctttatgtgtcctcatataccatacagatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagggggactttggaacacaaaaagaagctgcttgggcaatcagcaacttaacaataagtggcagaaaagatcaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtttggagaaaattgaagttttacagcaacatgaaaatgaagacatatataaattagcatttgaaatcatagatcagtatttctctggtgatgatattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagttttaaaaaaaaaaaaaactacttcatctaccagtaattgatgtgtttattatctgcctcagaagccagggttggaggaagaactttagatatggatattaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgcttttggtaaattgtctgacccagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagtttcttctggactttccttacttaactgacagttaccttttaaaatttgcacacattatgattaaaattgggcctctactgtgatgattcctatttcctctcatgttttaaagtgcaaactaacatttaagtgaacattagcatcaagtagtgcagacacttgtatgcatttccttgattcaatttgtgaccttaccagttttgaattggaattgcaccatttcgtagataaaggaaactaagtatattgctgcacttttaagttttcaaaacagtgtttaaaaattgcattgttatttttttttaaactcagtttaaaaagactaaaacgttctttcaaaagaggcatctaaatgtgttcctaattttgtatatgggcttaggttttgtaaccaataaaaaaagctgctatc

SEQ ID NO: 322449 - DNA, 4165 bp, Homo sapiens
gctactgccacctcgcgctcggaggcgtcacagaacgtgctcttctctcccctcccccctcccgctctccccctcctccccctcccgctccaagattcgccgccgccgccgccgcagccgcaggagtagccgccgccggagccgcgcgcagccatggccgagaaccccagcttggagaaccaccgcatcaagagcttcaagaacaagggccgcgatgtggaaacaatgcgaagacatagaaatgaagtgacagtggaactgcggaagaacaaaagagatgaacacttattgaaaaagagaaatgttccccaagaagaaagtctagaagattcagatgttgatgctgattttaaagcacaaaatgtaaccctagaagctatattgcagaatgccacaagtgataacccagtggtccaattgagtgctgtccaggcagcaagaaaactgttatccagtgacagaaatccaccgattgatgacttaataaaatctgggattttaccaattctagtcaaatgtctagaaagggatgataatccttcattacagtttgaagctgcttgggcattaactaacatagcatcaggaacttctgcacagactcaagctgttgtgcagtctaatgcagtacctctttttctgagacttcttcgttcaccacatcagaatgtttgtgaacaagcagtatgggctttgggaaacattataggtgatggtcctcaatgtagagattatgtcatatcactgggagttgtcaaacctcttctgtccttcatcagtccctccatccccatcaccttccttcggaacgtcacatgggtcattgtcaatctctgcaggaataaggatcccccaccgcctatggagacagttcaggagattttgccagctttatgtgtcctcatataccatacagatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagggggactttggaacacaaaaagaagctgcttgggcaatcagcaacttaacaataagtggcagaaaagatcaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtttggagaaaattgaagttttacagcaacatgaaaatgaagacatatataaattagcatttgaaatcatagatcagtatttctctggtgatgatattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagttttaaaaaaaaaaaaaactacttcatctaccagtaattgatgtgtttattatctgcctcagaagccagggttggaggaagaactttagatatggatattaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgcttttggtaaattgtctgacccagttattaatgaaagaatatggatttaaaaatttttaaactaaataatttgtgctgtcacagaaatggtattgttgctcttgtttactgggtataatttcccaatgcattgatgtgaagggatagtgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagtttcttctggactttccttacttaactgacagttaccttttaaaatttgcacacattatgattaaaattgggcctctactgtgatgattcctatttcctctcatgttttaaagtgcaaactaacatttaagtgaacattagcatcaagtagtgcagacacttgtatgcatttccttgattcaatttgtgaccttaccagttttgaattggaattgcaccatttcgtagataaaggaaactaagtatattgctgcacttttaagttttcaaaacagtgtttaaaaattgcattgttatttttttttaaactcagtttaaaaagactaaaacgttctttcaaaagaggcatctaaatgtgttcctaattttgtatatgggcttaggttttgtaaccaataaaaaaagctgctatcaaatatgataaaacattgaaaacttaaaaaaaa

SEQ ID NO: 322450 - DNA, 3899 bp, Homo sapiens
gctactgccacctcgcgctcggaggcgtcacagaacgtgctcttctctcccctcccccctcccgctctccccctcctccccctcccgctccaagattcgccgccgccgccgccgcagccgcaggagtagccgccgccggagccgcgcgcagccatggccgagaaccccagcttggagaaccaccgcatcaagagcttcaagaacaagggccgcgatgtggaaacaatgcgaagacatagaaatgaagtgacagtggaactgcggaagaacaaaagagatgaacacttattgaaaaagagaaatgttccccaagaagaaagtctagaagattcagatgttgatgctgattttaaagcacaaaatgtaaccctagaagctatattgcagaatgccacaagtgataacccagtggtccaattgagtgctgtccaggcagcaagaaaactgttatccagtgacagaaatccaccgattgatgacttaataaaatctgggattttaccaattctagtcaaatgtctagaaagggatgataatccttcattacagtttgaagctgcttgggcattaactaacatagcatcaggaacttctgcacagactcaagctgttgtgcagtctaatgcagtacctctttttctgagacttcttcgttcaccacatcagaatgtttgtgaacaagcagtatgggctttgggaaacattataggtgatggtcctcaatgtagagattatgtcatatcactgggagttgtcaaacctcttctgtccttcatcagtccctccatccccatcaccttccttcggaacgtcacatgggtcattgtcaatctctgcaggaataaggatcccccaccgcctatggagacagttcaggagattttgccagctttatgtgtcctcatataccatacagatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagggggactttggaacacaaaaagaagctgcttgggcaatcagcaacttaacaataagtggcagaaaagatcaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtttggagaaaattgaagttttacagcaacatgaaaatgaagacatatataaattagcatttgaaatcatagatcagtatttctctggtgatgatattgatgaagatccctgcctcattcctgaagcaacacaaggagtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagttttaaaaaaaaaaaaaactacttcatctaccagtaattgatgtgtttattatctgcctcagaagccagggttggaggaagaactttagatatggatattaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgcttttggtaaattgtctgacccagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagtttcttctggactttccttacttaactgacagttaccttttaaaatttgcacacattatgattaaaattgggcctctactgtgatgattcctatttcctctcatgttttaaagtgcaaactaacatttaagtgaacattagcatcaagtagtgcagacacttgtatgcatttccttgattcaatttgtgaccttaccagttttgaattggaattgcaccatttcgtagataaaggaaactaagtatattgctgcacttttaagttttcaaaacagtgtttaaaaattgcattgttatttttttttaaactcagtttaaaaagactaaaacgttctttcaaaagaggcatctaaatgtgttcctaattttgtatatgggcttaggttttgtaaccaataaaaaaagctgctatcaaatatgataaaacattgaaaacttaaaaaaaa

SEQ ID NO: 322451 - DNA, 2864 bp, Homo sapiens
  misc_feature (48)..(48): n is a, c, g, or t
acaatgttgggaacctgactctgaagcattgttaaaggtgtttctccntgctccattgcatcagggtcacatagccaactttgtacaggacgagtttgcttcaaaagagaaaggtatgcgtgaaaaacatctgcctttacattctcttcacgctctttaaatctggatattagtgcaggagagacggtcttgtagaattctggaagcatttcatgccttgtgctaactacagcatccaagcacttagcagctgtctggtgatgatattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagttttaaaaaaaaaaaaaactacttcatctaccagtaattgatgtgtttattatctgcctcagaagccagggttggaggaagaactttagatatggatattaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgcttttggtaaattgtctgacccagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagtttcttctggactttccttacttaactgacagttaccttttaaaatttgcacacattatgattaaaattgggcctctactgtgatgattcctatttcctctcatgttttaaagtgcaaactaacatttaagtgaacattagcatcaagtagtgcagacacttgtatgcatttccttgattcaatttgtgaccttaccagttttgaattggaattgcaccatttcgtagataaaggaaactaagtatattgctgcacttttaagttttcaaaacagtgtttaaaaattgcattgttatttttttttaaactcagtttaaaaagactaaaacgttctttcaaaagaggcatctaaatgtgttcctaattttgtatatgggcttaggttttgtaaccaataaaaaaagctgctatcaaatatgataaaacattgaaaacttaaaaaaaa

SEQ ID NO: 322452 - DNA, 2039 bp, Homo sapiens
gctactgccacctcgcgctcggaggcgtcacagaacgtgctcttctctcccctcccccctcccgctctccccctcctccccctcccgctccaagattcgccgccgccgccgccgcagccgcaggagtagccgccgccggagccgcgcgcagccatggccgagaaccccagcttggagaaccaccgcatcaagagcttcaagaacaagggccgcgatgtggaaacaatgcgaagacatagaaatgaagtgacagtggaactgcggaagaacaaaagagatgaacacttattgaaaaagagaaatgttccccaagaagaaagtctagaagattcagatgttgatgctgattttaaagcacaaaatgtaaccctagaagctatattgcagaatgccacaagtgataacccagtggtccaattgagtgctgtccaggcagcaagaaaactgttatccagtgacagaaatccaccgattgatgacttaataaaatctgggattttaccaattctagtcaaatgtctagaaagggatgataatccttcattacagtttgaagctgcttgggcattaactaacatagcatcaggaacttctgcacagactcaagctgttgtgcagtctaatgcagtacctctttttctgagacttcttcgttcaccacatcagaatgtttgtgaacaagcagtatgggctttgggaaacattataggtgatggtcctcaatgtagagattatgtcatatcactgggagttgtcaaacctcttctgtccttcatcagtccctccatccccatcaccttccttcggaacgtcacatgggtcattgtcaatctctgcaggaataaggatcccccaccgcctatggagacagttcaggagattttgccagctttatgtgtcctcatataccatacagatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagggggactttggaacacaaaaagaagctgcttgggcaatcagcaacttaacaataagtggcagaaaagatcaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtttggagaaaattgaagttttacagcaacatgaaaatgaagacatatataaattagcatttgaaatcatagatcagtatttctctggtgatgatattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtga

SEQ ID NO: 322453 - DNA, 441 bp, Homo sapiens
gccctttcttgtgccccttctgagccatcaggaagtcaaagttcaagtaagtatttttaaatttttcttatttgtatacagttgtgtttgctataaccagttaacttgtacagctaggctttaattctatctgtaagtgcttatcttccacatttcttctgctagtccctgagcctgattttgttgatttccaaatctttatctcacccagtttctttgctgagttccacacttgtatagccaattgttcttgaccctttatacatatcatctaagaactccttcaagctttccgtggttaactagacagaaatgaaacgatcatctcccacaaacctgctcttcttccttgtctaccttcagtgaacagcatggcctaagctagaaattttgattcctccttgcaattcccattccattacaaaatcatttcaattcttc

SEQ ID NO: 322454 - DNA, 331 bp, Homo sapiens
ctaatttgtctagagagagaattatgtcattcctcagttgtgttacctggtagtctagaagttaatatgttgttatttcttttcacagtttgaaaattatagcaattaatttctcatatttattttcctagaaaactgttatccagtgacagaaatccaccgattgatgacttaataaaatctgggattttaccaattctagtcaaatgtctagaaagggatgataagtaagtatggattttactccctattcagtttttttcagttaacttaaaagtttggattattacttaaccagtgagttcagtttggttttgtacttatgatgttt

SEQ ID NO: 322455 - DNA, 2245 bp, Homo sapiens
aattcgtggttccagaatcgatagggctccaagattcgccgccgccgccgccgcagccgcaggagtagccgccgccggagccgcgcgcagccatggccgagaaccccagcttggagaaccaccgcatcaagagcttcaagaacaagggccgcgatgtggaaacaatgcgaagacatagaaatgaagtgacagtggaactgcggaagaacaaaagagatgaacacttattgaaaaagagaaatgttccccaagaagaaagtctagaagattcagatgttgatgctgattttaaagcacaaaatgtaaccctagaagctatattgcagaatgccacaagtgataacccagtggtccaattgagtgctgtccaggcagcaagaaaactgttatccagtgacagaaatccaccgattgatgacttaataaaatctgggattttaccaattctagtcaaatgtctagaaagggatgataatccttcattacagtttgaagctgcttgggcattaactaacatagcatcaggaacttctgcacagactcaagctgttgtgcagtctaatgcagtacctctttttctgagacttcttcgttcaccacatcagaatgtttgtgaacaagcagtatgggctttgggaaacattataggtgatggtcctcaatgtagagattatgtcatatcactgggagttgtcaaacctcttctgtccttcatcagtccctccatccccatcaccttccttcggaacgtcacatgggtcattgtcaatctctgcaggaataaggatcccccaccgcctatggagacagttcaggagattttgccagctttatgtgtcctcatataccatacagatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagggggactttggaacacaaaaagaagctgcttgggcaatcagcaacttaacaataagtggcagaaaagatcaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtttggagaaaattgaagttttacagcaacatgaaaatgaagacatatataaattagcatttgaaatcatagatcagtatttctctggtgatgatattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagtttt

SEQ ID NO: 322456 - DNA, 553 bp, Homo sapiens
gtctcattaaggtgacattagcaggtactatttgcaaactcggcttattgaggcagcgctagaggtctctctgcagctactgaaaacaacaatgcgaagacatagaaatgaagtgacagtggaactgcggaagaacaaaagagatgaacacttattgaaaaagagaaatgttccccaagaagaaagtctagaagattcagatgttgatgctgattttaaagcacaaaatgtaaccctagaagctatattgcagaatgccacaagtgataacccagtggtccaattgagtgctgtccaggcagcaagaaaactgttatccagtgacagaaatccaccgattgatgacttaataaaatctgggattttaccaattctagtcaaatgtctagaaagggatgataatccttcattacagtttgaagctgcttgggcattaactaacatagcatcaggaaaatggcgtgaacccgggaggcggagcttgcagtgagccgagatcacgccactgcactccaacctgggcgacagagcaagactccgtctcaaaaaaaaa

SEQ ID NO: 322457 - DNA, 4443 bp, Homo sapiens
ggattacaggtgtgagccactgcacccagccaatattaaatgacttctaactcaaatacctgagtttttttttttcttcttcttcttttttttgagatgcagtctcgctctgtcgcccaggcctggagtgcactggcgccacctcggcttgctgcatccccccgcctcccgggttcaagcagttctcctgcctcagtctcccatgtagctgagattacaggtgcctgccaccaagcccggctaattttttttgtatttttagtagagactaggtttcgccatgttggccaagctggttttgaactcctgacctcaagtgatctgcccgcctcggcctcccaaagtgctaggattataggcatgagccactgcacccagctgagatctttatatactagcagtgtccgtattttgatacatctgtaatctttgtttttcttttctagacaatgcgaagacatagaaatgaagtgacagtggaactgcggaagaacaaaagagatgaacacttattgaaaaagagaaatgttccccaagaagaaagtctagaagattcagatgttgatgctgattttaaagcacaaaatgtaaccctagaagctatattgcagaatgccacaagtgataacccagtggtccaattgagtgctgtccaggcagcaagaaaactgttatccagtgacagaaatccaccgattgatgacttaataaaatctgggattttaccaattctagtcaaatgtctagaaagggatgataatccttcattacagtttgaagctgcttgggcattaactaacatagcatcaggaacttctgcacagactcaagctgttgtgcagtctaatgcagtacctctttttctgagacttcttcgttcaccacatcagaatgtttgtgaacaagcagtatgggctttgggaaacattataggtgatggtcctcaatgtagagattatgtcatatcactgggagttgtcaaacctcttctgtccttcatcagtccctccatccccatcaccttccttcggaacgtcacatgggtcattgtcaatctctgcaggaataaggatcccccaccgcctatggagacagttcaggagattttgccagctttatgtgtcctcatataccatacagatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagggggactttggaacacaaaaagaagctgcttgggcaatcagcaacttaacaataagtggcagaaaagatcaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtttggagaaaattgaagttttacagcaacatgaaaatgaagacatatataaattagcatttgaaatcatagatcagtatttctctggtgatgatattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagttttaaaaaaaaaaaaaactacttcatctaccagtaattgatgtgtttattatctgcctcagaagccagggttggaggaagaactttagatatggatattaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgcttttggtaaattgtctgacccagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagtttcttctggactttccttacttaactgacagttaccttttaaaatttgcacacattatgattaaaattgggcctctactgtgatgattcctatttcctctcatgttttaaagtgcaaactaacatttaagtgaacattagcatcaagtagtgcagacacttgtatgcatttccttgattcaatttgtgaccttaccagttttgaattggaattgcaccatttcgtagataaaggaaactaagtatattgctgcacttttaagttttcaaaacagtgtttaaaaattgcattgttatttttttttaaactcagtttaaaaagactaaaacgttctttcaaaagaggcatctaaatgtgttcctaattttgtatatgggcttaggttttgtaaccaataaaaaaagctgctatcaaatatgataaaacattgaaaacttaaaaaaaa

SEQ ID NO: 322458 - DNA, 3346 bp, Homo sapiens
gtgtctacaagaatgtttatatctgtatggtatatgaggacacatataaacattcttgtagacactgtttgggctctgtcatacttgacagatggaggtaatgaacagatacagatggttattgattcaggagttgtgccctttcttgtgccccttctgagccatcaggaagtcaaagttcaaacagcagccctcagagcagttggcaacatagtgactggcaccgacgagcagacccaggttgttctcaattgtgatgtcctgtcacacttcccaaatctcttatcacacccaaaagagaagataaataaggaagcagtgtggttcctttccaacataacagcaggcaaccagcaacaagttcaagctgtaatagatgctggattaattcctatgataattcatcagcttgctaagggggactttggaacacaaaaagaagctgcttgggcaatcagcaacttaacaataagtggcagaaaagatcaggttgagtaccttgtacagcagaatgtaataccaccgttctgtaatttactgtcagtgaaagattctcaagtggttcaggtggttctagatggtctaaaaaacattctgataatggccggtgatgaagcaagcacaatagctgaaataatagaggaatgtggaggtttggagaaaattgaagttttacagcaacatgaaaatgaagacatatataaattagcatttgaaatcatagatcagtatttctctggtgatgatattgatgaagatccctgcctcattcctgaagcaacacaaggaggtacctacaattttgatccaacagccaaccttcaaacaaaagaatttaatttttaaattcagttgagtgcagcatctttcccacattcaatatgaagcaccaccagatggctaccaaatgataagaacaacagcaacaaaaggctccaaaacacacatgcctctttgttttgatgcttctaaagcaagccatgtctcagtcactttgcagttgccaaaagtcactatcacatggactgtaaatgcatatgcatgatttcctaaactgttttagaactctccttaacaatctcaactaccctatttttccctgttccctggtgccacaggctgacaactgcagtctccagtttagaataaatattccatagtggtgacatgtcagctgcccactgatactcctttggaaaatggtgcgctgtggatcaagacactttggtatgatgcatatacaagttggaagactaaagaggtgcagtgtgatctgagcctccatcattgtcctccacaaacatattttcatattctttatgtggaagaatagattttaaagtacaagccaaatgattttcattggtggaactgacacaaaaaaagtaacttaaaaacaagaaacttggttattgaataaacagataagttttaaaaaaaaaaaaaactacttcatctaccagtaattgatgtgtttattatctgcctcagaagccagggttggaggaagaactttagatatggatattaatgcttttgccattatacctaatttttgagaacagcaagccctatttgaccactctcttcagcctgtgtgttcctgctgttttgaagtaatcaaatgctgtgcatggtattttacctgagctgcaacctgttatggacttgaacttctgtttaagttgaaagcaagagtccctgagtataaaggaaaaacagcaaaacaaaaagcaaacaaaaaaaaactgcaaaagtctaaaatacccattggtgatgttttttaaaaaaatcttgctttcagctttcaggagttaatattctttgttttaatttgataattggatatggttgatttatattgggtttaaactgtggagctttcatgtttactgtaatttagtcttaaaatattttttacttagtaaccagtgcttttgataatgtggttggcaacaaaccagcaactatttagaagtgtcataagagttcattctttgagtattgggaaagttaattcagatcctactcaaaaagcatcttcacatattaaaagattcagacagggatctgtgtagaggagtaatttgcagttatttaacataaacctgatttgcagtgatctctaagtaattctgcaaaatccggtattactatgtcaagttattgcttttggtaaattgtctgacccagttattaatgaaagaatatggatttaaaaatttttaaactaaataatttgtgctgtcacagaaatggtattgttgctcttgtttactgggtataatttcccaatgcattgatgtgaagggatagaaaatctaaactaatttagttatccattggggggtgtatttactgtgatgaagatgagacagatgccatcagagctttgtgaatcagctggggtgttttcactgataaacaacacatagcaggtgtgcattcattacaaatatatgtatctgccaaggtggagccactttaaagagtgagttttgtcttgtatctaaagtggatacaagcgtatgtttaaactgcaagatttttacttgctagagaatctgttttaatatagtggtttggcctctgattatttataggttttataaattttagaatcaatttctctttaaggtggctcagatttttcaactcttgtgcacataaaattgagttgaagttcattgtgcctttttttctttatccaaattttgagttaaagcttcatatggtaactgcatcctgttcggacactatagtctaaatttttgaaactgtgtggtgttcgctaaaagtaggaataacaacgtaaaagctaattaaggtcacaaacttcggtgaaacccttaaaagtccaaatcttcttgatattgtgaaccgtaccccttccagtttagtttcttctggactttccttacttaactgacagttaccttttaaaatttgcacacattatgattaaaattgggcctctactgtgatgattcctatttcctctcatgttttaaagtgcaaactaacatttaagtgaacattagcatcaagtagtgcagacacttgtatgcatttccttgattcaatttgtgaccttaccagttttgaattggaattgcaccatttcgtagataaaggaaactaagtatattgctgcacttttaagttttcaaaacagtgtttaaaaattgcattgttatttttttttaaactcagtttaaaaagactaaaacgttctttcaaaagaggcatctaaatgtgttcctaattttgtatatgggcttaggttttgtaaccaataaaaaaagctgctatcaaatatgataaaacattgaaaacttaaaaaaaa

SEQ ID NO: 322459 - DNA, 957 bp, Homo sapiens
  misc_feature (886)..(886): n is a, c, g, or t
  misc_feature (917)..(917): n is a, c, g, or t
  misc_feature (948)..(948): n is a, c, g, or t
gctactgccacctcgcgctcggaggcgtcacagaacgtgctcttctctcccctcccccctcccgctctccccctcctccccctcccgctccaagattcgccgccgccgccgccgcagccgcaggagtagccgccgccggagccgcgcgcagccatggccgagaaccccagcttggagaaccaccgcatcaagagcttcaagaacaagggccgcgatgtggaaacaatgcgaagacatagaaatgaagtgacagtggaactgcggaagaacaaaagagatgaacacttattgaaaaagagaaatgttccccaagaagaaagtctagaagattcagatgttgatgctgattttaaagcacaaaatgtaaccctagaagctatattgcagaatgccacaagtgataacccagtggtccaattgagtgctgtccaggcagcaagaaaactgttatccagtgacagaaatccaccgattgatgacttaataaaatctgggattttaccaattctagtcaaatgtctagaaagggatgataatccttcattacagtttgaagctgcttgggcattaactaacatagcatcaggaacttctgcacagactcaagctgttgtgcagtctaatgcagtacctctttttctgagacttcttcgttcaccacatcagaatgtttgtgaacaagcagtatgggctttgggaaacattataggtgatggtcctcaatgtagagattatgtcatatcactgggagttgtcaaacctcttctgtccttcatcagtccctccatccccatcaccttccttcggaacgtcacatgggtcattgtcaatctctgcaggaataaggatcccccaccgcctatggagacagttcaggagattttgnccgctttatggggtcctcattttcccttccngattttaaccatctttggagaccactggttngggcttttg

SEQ ID NO: 322460 - DNA, 2466 bp, Homo sapiens
agcggatcggccgccgttgcgcggcgcagagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataactta

SEQ ID NO: 322461 - DNA, 817 bp, Homo sapiens
agcggatcggccgccgttgcgcggcgcagagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtgaaatcttcttaaaaaaaaaaggggggggg

SEQ ID NO: 322462 - DNA, 959 bp, Homo sapiens
agattttaaagattatttctcagaggctggtgatagatactttaaccagggttagtggcttttatatgttttacctaaaggatcacttttctctgctgcacataacagaatgtggtttttggcttgctgtaaggagactagtttaaatgctagtatagaaaacttttaaaaacatcctagatttggagcttgtctgtgagcagacagcctatcatgaataggagcaaacctctaggagagttattttagagtggaagtggatatcctgatttagtcgaataaaatagcagccttggtattaatgggaaatctgcaataatcagggtttcagccccatcagcgtagtcaggagtttggtgagattatttgccagggtggtgtaggtctagttttctttgtgcccttgtttgggactatattttgcctgttgcaaggtcctcactaacttatgggctctgattcttcctatttgagttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtgaaatcttcttaaaaaaaaaaggggggggg

SEQ ID NO: 322463 - DNA, 2602 bp, Homo sapiens
  misc_feature (29)..(29): n is a, c, g, or t
  misc_feature (46)..(46): n is a, c, g, or t
  misc_feature (51)..(51): n is a, c, g, or t
  misc_feature (56)..(56): n is a, c, g, or t
  misc_feature (68)..(70): n is a, c, g, or t
  misc_feature (75)..(75): n is a, c, g, or t
  misc_feature (79)..(79): n is a, c, g, or t
  misc_feature (83)..(84): n is a, c, g, or t
  misc_feature (105)..(105): n is a, c, g, or t
  misc_feature (115)..(115): n is a, c, g, or t
  misc_feature (120)..(120): n is a, c, g, or t
  misc_feature (130)..(130): n is a, c, g, or t
  misc_feature (158)..(158): n is a, c, g, or t
  misc_feature (163)..(163): n is a, c, g, or t
  misc_feature (165)..(165): n is a, c, g, or t
  misc_feature (172)..(172): n is a, c, g, or t
aggtattatattgagatggagtcttgctntttgacccaggctggantgcantgatntgatctcagctnnntgcancctncacnnctcgggttcaagcgattctcntgcctcagcnccttnagtaactggnactacaggcatgtgctaccacgcttggntaatntntgtattnttagtagagcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataactta

SEQ ID NO: 322464 - DNA, 2546 bp, Homo sapiens
agcggatcggccgccgttgcgcggcgcagagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataacttaatctaagtggtaagctatggttcttgttttcattcaacacatttgccatagcatgggcttggggagtctccagaagatgg

SEQ ID NO: 322465 - DNA, 2608 bp, Homo sapiens
agattttaaagattatttctcagaggctggtgatagatactttaaccagggttagtggcttttatatgttttacctaaaggatcacttttctctgctgcacataacagaatgtggtttttggcttgctgtaaggagactagtttaaatgctagtatagaaaacttttaaaaacatcctagatttggagcttgtctgtgagcagacagcctatcatgaataggagcaaacctctaggagagttattttagagtggaagtggatatcctgatttagtcgaataaaatagcagccttggtattaatgggaaatctgcaataatcagggtttcagccccatcagcgtagtcaggagtttggtgagattatttgccagggtggtgtaggtctagttttctttgtgcccttgtttgggactatattttgcctgttgcaaggtcctcactaacttatgggctctgattcttcctatttgagttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataactta

SEQ ID NO: 322466 - DNA, 1653 bp, Homo sapiens
  misc_feature (1627)..(1627): n is a, c, g, or t
agcggatcggccgccgttgcgcggcgcagagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggctangaccttggggcttaagggacccttgg

SEQ ID NO: 322467 - DNA, 2012 bp, Homo sapiens
  misc_feature (29)..(29): n is a, c, g, or t
  misc_feature (46)..(46): n is a, c, g, or t
  misc_feature (51)..(51): n is a, c, g, or t
  misc_feature (56)..(56): n is a, c, g, or t
  misc_feature (68)..(70): n is a, c, g, or t
  misc_feature (75)..(75): n is a, c, g, or t
  misc_feature (79)..(79): n is a, c, g, or t
  misc_feature (83)..(84): n is a, c, g, or t
  misc_feature (105)..(105): n is a, c, g, or t
  misc_feature (115)..(115): n is a, c, g, or t
  misc_feature (120)..(120): n is a, c, g, or t
  misc_feature (130)..(130): n is a, c, g, or t
  misc_feature (158)..(158): n is a, c, g, or t
  misc_feature (163)..(163): n is a, c, g, or t
  misc_feature (165)..(165): n is a, c, g, or t
  misc_feature (172)..(172): n is a, c, g, or t
aggtattatattgagatggagtcttgctntttgacccaggctggantgcantgatntgatctcagctnnntgcancctncacnnctcgggttcaagcgattctcntgcctcagcnccttnagtaactggnactacaggcatgtgctaccacgcttggntaatntntgtattnttagtagagcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaattgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataactta

SEQ ID NO: 322468 - DNA, 1413 bp, Homo sapiens
tttaagacggccccccttttgttttgttttttttggttacggcagcacttttattgtttccgtacacaatgacgtgttgctggggcctaatgttctcacataacagtagaaaaccaaatttgttgtcatctcttcaaagaatcgagaattgcgtacaaaaaaaaccttacataaattaagaatgaatacatttacaggcgtaaatgcaaccgcttccaactcaaagcaagtaacagcccacggtgttctggccaaagacatcagctaagaaaggaaactgggtcctacggcttggactttccaaccctgacagacccgcaagacaaaacaactggttcttgccagcctctagagaaatcccagaacactcagccctgacacgttaataccctgcacagatcagaggctgctggccacacagactcaccaagccacagacttgtcttccacaagcacgttcttaccttagccacgaagtgaccaagccacacgtactaaaggttgaactcaaagacctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataactta

SEQ ID NO: 322469 - DNA, 441 bp, Homo sapiens
  misc_feature (9)..(9): n is a, c, g, or t
  misc_feature (24)..(24): n is a, c, g, or t
  misc_feature (30)..(30): n is a, c, g, or t
  misc_feature (45)..(45): n is a, c, g, or t
  misc_feature (76)..(76): n is a, c, g, or t
  misc_feature (81)..(81): n is a, c, g, or t
  misc_feature (83)..(83): n is a, c, g, or t
  misc_feature (86)..(86): n is a, c, g, or t
  misc_feature (100)..(100): n is a, c, g, or t
  misc_feature (113)..(113): n is a, c, g, or t
caaggtgcntagccctcagcagcnttggancacatgcatgcctgntgggcccccgccgccctgcccgcgtgaacgncgccncnggntgcccgggacgccngcgcaaacaccangcggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataactta

SEQ ID NO: 322470 - DNA, 2410 bp, Homo sapiens
tcgaatcgtaaccgttcgtacgagaatcgctgtcctctccttgcggccgccagtctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataactta

SEQ ID NO: 322471 - DNA, 3821 bp, Homo sapiens
agggagtgttcccgggggagatactccagtcgtagcaagagtctcgaccactgaatggaagaaaaggacttttaaccaccattttgtgacttacagaaaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccatagaagtgaaggacatcaacgacaatcgacccacgtttctccagtcaaagtacgaaggctcagtaaggcagaactctcgcccaggaaagcccttcttgtatgtcaatgccacagacctggatgatccggccactcccaatggccagctttattaccagattgtcatccagcttcccatgatcaacaatgtcatgtactttcagatcaacaacaaaacgggagccatctctcttacccgagagggatctcaggaattgaatcctgctaagaatccttcctataatctggtgatctcagtgaaggacatgggaggccagagtgagaattccttcagtgataccacatctgtggatatcatagtgacagagaatatttggaaagcaccaaaacctgtggagatggtggaaaactcaactgatcctcaccccatcaaaatcactcaggtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaaccgtatttgaggtccaggagaatgaacgactgggtaacagtatcgggacccttactgcacatgacagggatgaagaaaatactgccaacagttttctaaactacaggattgtggagcaaactcccaaacttcccatggatggactcttcctaatccaaacctatgctggaatgttacagttagctaaacagtccttgaagaagcaagatactcctcagtacaacttaacgatagaggtgtctgacaaagatttcaagaccctttgttttgtgcaaatcaacgttattgatatcaatgatcagatccccatctttgaaaaatcagattatggaaacctgactcttgctgaagacacaaacattgggtccaccatcttaaccatccaggccactgatgctgatgagccatttactgggagttctaaaattctgtatcatatcataaagggagacagtgagggacgcctgggggttgacacagatccccataccaacaccggatatgtcataattaaaaagcctcttgattttgaaacagcagctgtttccaacattgtgttcaaagcagaaaatcctgagcctctagtgtttggtgtgaagtacaatgcaagttcttttgccaagttcacgcttattgtgacagatgtgaatgaagcacctcaattttcccaacacgtattccaagcgaaagtcagtgaggatgtagctataggcactaaagtgggcaatgtgactgccaaggatccagaaggtctggacataagctattcactgaggggagacacaagaggttggcttaaaattgaccacgtgactggtgagatctttagtgtggctccattggacagagaagccggaagtccatatcgggtacaagtggtggccacagaagtaggggggtcttccttgagctctgtgtcagagttccacctgatccttatggatgtgaatgacaaccctcccaggctagccaaggactacacgggcttgttcttctgccatcccctcagtgcacctggaagtctcattttcgaggctactgatgatgatcagcacttatttcggggtccccattttacattttccctcggcagtggaagcttacaaaacgactgggaagtttccaaaatcaatggtactcatgcccgactgtctaccaggcacacagactttgaggagagggagtatgtcgtcttgatccgcatcaatgatgggggtcggccacccttggaaggcattgtttctttaccagttacattctgcagttgtgtggaaggaagttgtttccggccagcaggtcaccagactgggatacccactgtgggcatggcagttggtatactgctgaccacccttctggtgattggtataattttagcagttgtgtttatccgcataaagaaggataaaggcaaagataatgttgaaagtgctcaagcatctgaagtcaaacctctgagaagctgaatttgaaaaggaatgtttgaatttatatagcaagtgctatttcagcaacaaccatctcatcctattacttttcatctaacgtgcattataattttttaaacagatattccctcttgtcctttaatatttgctaaatatttcttttttgaggtggagtcttgctctgtcgcccaggctggagtacagtggtgtgatcccagctcactgcaacctccgcctcctgggttcacatgattctcctgcctcagcttcctaagtagctgggtttacaggcacccaccaccatgcccagctaatttttgtatttttaatagagacggggtttcgccatttggccaggctggtcttgaactcctgacgtcaagtgatctgcctgccttggtctcccaatacaggcatgaaccactgcacccacctacttagatatttcatgtgctatagacattagagagatttttcatttttccatgacatttttcctctctgcaaatggcttagctacttgtgtttttcccttttggggcaagacagactcattaaatattctgtacattttttctttatcaaggagatatatcagtgttgtctcatagaactgcctggattccatttatgttttttctgattccatcctgtgtccccttcatccttgactcctttggtatttcactgaatttcaaacatttgtcagagaagaaaaaagtgaggactcaggaaaaataaataaataaaagaacagccttttcccttagtattaacagaaatgtttctgtgtcattaaccatctttaatcaatgtgacatgttgctctttggctgaaattcttcaacttggaaatgacacagacccacagaaggtgttcaaacacaacctactctgcaaaccttggtaaaggaaccagtcagctggccagatttcctcactacctgccatgcatacatgctgcgcatgttttcttcattcgtatgttagtaaagttttggttattatatatttaacatgtggaagaaaacaagacatgaaaagagtggtgacaaatcaagaataaacactggttgtagtcagttttgtttggtgatccgctctgcctctgtttttatttgtggaggggaaggacagaataacaattgttattttttgtgtataaaaattgcctccccagcagccctagtcaggggcttatagataaaactcccatctcc

SEQ ID NO: 322472 - DNA, 3215 bp, Homo sapiens
catgtttgaagccagtgaggatgtagctataggcactaaagtgggcaatgtgactgccaaggatccagaaggtctggacataagctattcactgaggggagacacaagaggttggcttaaaattgaccacgtgactggtgagatctttagtgtggctccattggacagagaagccggaattccttcagtgataccacatctgtggatatcatagtgacagagaatatttggaaagcaccaaaacctgtggagatggtggaaaactcaactgatcctcaccccatcaaaatcactcaggtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaaccgtatttgaggtccaggagaatgaacgactgggtaacagtatcgggacccttactgcacatgacagggatgaagaaaatactgccaacagttttctaaactacaggattgtggagcaaactcccaaacttcccatggatggactcttcctaatccaaacctatgctggaatgttacagttagctaaacagtccttgaagaagcaagatactcctcagtacaacttaacgatagaggtgtctgacaaagatttcaagaccctttgttttgtgcaaatcaacgttattgatatcaatgatcagatccccatctttgaaaaatcagattatggaaacctgactcttgctgaagacacaaacattgggtccaccatcttaaccatccaggccactgatgctgatgagccatttactgggagttctaaaattctgtatcatatcataaagggagacagtgagggacgcctgggggttgacacagatccccataccaacaccggatatgtcataattaaaaagcctcttgattttgaaacagcagctgtttccaacattgtgttcaaagcagaaaatcctgagcctctagtgtttggtgtgaagtacaatgcaagttcttttgccaagttcacgcttattgtgacagatgtgaatgaagcacctcaattttcccaacacgtattccaagcgaaagtcagtgaggatgtagctataggcactaaagtgggcaatgtgactgccaaggatccagaaggtctggacataagctattcactgaggggagacacaagaggttggcttaaaattgaccacgtgactggtgagatctttagtgtggctccattggacagagaagccggaagtccatatcgggtacaagtggtggccacagaagtaggggggtcttccttgagctctgtgtcagagttccacctgatccttatggatgtgaatgacaaccctcccaggctagccaaggactacacgggcttgttcttctgccatcccctcagtgcacctggaagtctcattttcgaggctactgatgatgatcagcacttatttcggggtccccattttacattttccctcggcagtggaagcttacaaaacgactgggaagtttccaaaatcaatggtactcatgcccgactgtctaccaggcacacagactttgaggagagggagtatgtcgtcttgatccgcatcaatgatgggggtcggccacccttggaaggcattgtttctttaccagttacattctgcagttgtgtggaaggaagttgtttccggccagcaggtcaccagactgggatacccactgtgggcatggcagttggtatactgctgaccacccttctggtgattggtataattttagcagttgtgtttatccgcataaagaaggataaaggcaaagataatgttgaaagtgctcaagcatctgaagtcaaacctctgagaagctgaatttgaaaaggaatgtttgaatttatatagcaagtgctatttcagcaacaaccatctcatcctattacttttcatctaacgtgcattataattttttaaacagatattccctcttgtcctttaatatttgctaaatatttcttttttgaggtggagtcttgctctgtcgcccaggctggagtacagtggtgtgatcccagctcactgcaacctccgcctcctgggttcacatgattctcctgcctcagcttcctaagtagctgggtttacaggcacccaccaccatgcccagctaatttttgtatttttaatagagacggggtttcgccatttggccaggctggtcttgaactcctgacgtcaagtgatctgcctgccttggtctcccaatacaggcatgaaccactgcacccacctacttagatatttcatgtgctatagacattagagagatttttcatttttccatgacatttttcctctctgcaaatggcttagctacttgtgtttttcccttttggggcaagacagactcattaaatattctgtacattttttctttatcaaggagatatatcagtgttgtctcatagaactgcctggattccatttatgttttttctgattccatcctgtgtccccttcatccttgactcctttggtatttcactgaatttcaaacatttgtcagagaagaaaaaagtgaggactcaggaaaaataaataaataaaagaacagccttttcccttagtattaacagaaatgtttctgtgtcattaaccatctttaatcaatgtgacatgttgctctttggctgaaattcttcaacttggaaatgacacagacccacagaaggtgttcaaacacaacctactctgcaaaccttggtaaaggaaccagtcagctggccagatttcctcactacctgccatgcatacatgctgcgcatgttttcttcattcgtatgttagtaaagttttggttattatatatttaacatgtggaagaaaacaagacatgaaaagagtggtgacaaatcaagaataaacactggttgtagtcagttttgtttggtgatccgctctgcctctgtttttatttgtggaggggaaggacagaataacaattgttattttttgtgtataaaaattgcctccccagcagccctagtcaggggcttatagataaaactcccatctcc

SEQ ID NO: 322473 - DNA, 1411 bp, Homo sapiens
agggagtgttcccgggggagatactccagtcgtagcaagagtctcgaccactgaatggaagaaaaggacttttaaccaccattttgtgacttacagaaaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccatagaagtgaaggacatcaacgacaatcgacccacgtttctccagtcaaagtacgaaggctcagtaaggcagaactctcgcccaggaaagcccttcttgtatgtcaatgccacagacctggatgatccggccactcccaatggccagctttattaccagattgtcatccagcttcccatgatcaacaatgtcatgtactttcagatcaacaacaaaacgggagccatctctcttacccgagagggatctcaggaattgaatcctgctaagaatccttcctataatctggtgatctcagtgaaggacatgggaggccagagtgagaattccttcagtgataccacatctgtggatatcatagtgacagagaatatttggaaagcaccaaaacctgtggagatggtggaaaactcaactgatcctcaccccatcaaaatcactcaggtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaaccgtatttgaggtccaggagaatgaacgactgggtaacagtatcgggacccttactgcacatgacagggatgaagaaaatactgccaacagttttctaaactacaggattgtggagcaaactcccaaaccattgtacttcacaccaaacactagaggctcaggataattctgctcttgaacacaatagttggaaacagctgctgtttcaaaatcagaggctttttaattatgacagtactcccggtattggtatgggg

SEQ ID NO: 322474 - DNA, 2324 bp, Homo sapiens
agggagtgttcccgggggagatactccagtcgtagcaagagtctcgaccactgaatggaagaaaaggacttttaaccaccattttgtgacttacagaaaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccatagaagtgaaggacatcaacgacaatcgacccacgtttctccagtcaaagtacgaaggctcagtaaggcagaactctcgcccaggaaagcccttcttgtatgtcaatgccacagacctggatgatccggccactcccaatggccagctttattaccagattgtcatccagcttcccatgatcaacaatgtcatgtactttcagatcaacaacaaaacgggagccatctctcttacccgagagggatctcaggaattgaatcctgctaagaatccttcctataatctggtgatctcagtgaaggacatgggaggccagagtgagaattccttcagtgataccacatctgtggatatcatagtgacagagaatatttggaaagcaccaaaacctgtggagatggtggaaaactcaactgatcctcaccccatcaaaatcactcaggtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaaccgtatttgaggtccaggagaatgaacgactgggtaacagtatcgggacccttactgcacatgacagggatgaagaaaatactgccaacagttttctaaactacaggattgtggagcaaactcccaaacttcccatggatggactcttcctaatccaaacctatgctggaatgttacagttagctaaacagtccttgaagaagcaagatactcctcagtacaacttaacgatagaggtgtctgacaaagatttcaagaccctttgttttgtgcaaatcaacgttattgatatcaatgatcagatccccatctttgaaaaatcagattatggaaacctgactcttgctgaagacacaaacattgggtccaccatcttaaccatccaggccactgatgctgatgagccatttactgggagttctaaaattctgtatcatatcataaagggagacagtgagggacgcctgggggttgacacagatccccataccaacaccggatatgtcataattaaaaagcctcttgattttgaaacagcagctgtttccaacattgtgttcaaagcagaaaatcctgagcctctagtgtttggtgtgaagtacaatgcaagttcttttgccaagttcacgcttattgtgacagatgtgaatgaagcacctcaattttcccaacacgtattccaagcgaaagtcagtgaggatgtagctataggcactaaagtgggcaatgtgactgccaaggatccagaaggtctggacataagctattcactgaggggagacacaagaggttggcttaaaattgaccacgtgactggtgagatctttagtgtggctccattggacagagaagccggaagtccatatcgggtacaagtggtggccacagaagtaggggggtcttccttgagctctgtgtcagagttccacctgatccttatggatgtgaatgacaaccctcccaggctagccaaggactgtggtcaattttaagccaacctcttgtgtctcccctcagtgaatagcttatgtccagacttctggatcattggcagtcacattgcccactttagtgcctatagctacatcctcactgactttcgctcggaatacgtgttgggaaaatgaggtgcttcattcacatctgtcacaataagcatgacgtgcataaa

SEQ ID NO: 322475 - DNA, 1600 bp, Homo sapiens
agggagtgttcccgggggagatactccagtcgtagcaagagtctcgaccactgaatggaagaaaaggacttttaaccaccattttgtgacttacagaaaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccatagaagtgaaggacatcaacgacaatcgacccacgtttctccagtcaaagtacgaaggctcagtaaggcagaactctcgcccaggaaagcccttcttgtatgtcaatgccacagacctggatgatccggccactcccaatggccagctttattaccagattgtcatccagcttcccatgatcaacaatgtcatgtactttcagatcaacaacaaaacgggagccatctctcttacccgagagggatctcaggaattgaatcctgctaagaatccttcctataatctggtgatctcagtgaaggacatgggaggccagagtgagaattccttcagtgataccacatctgtggatatcatagtgacagagaatatttggaaagcaccaaaacctgtggagatggtggaaaactcaactgatcctcaccccatcaaaatcactcaggtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaaccgtatttgaggtccaggagaatgaacgactgggtaacagtatcgggacccttactgcacatgacagggatgaagaaaatactgccaacagttttctaaactacaggattgtggagcaaactcccaaacttcccatggatggactcttcctaatccaaacctatgctggaatgttacagttagctaaacagtccttgaagaagcaagatactcctcagtacaacttaacgatagaggtgtctgacaaagatttcaagaccctttgttttgtgcaaatcaacgttattgatatcaatgatcagatccccatctttgaaaaatcagattatggaaaactcaactgatcctcaccccatcaaaatcactcaggtgcggtggaatgatcccggtgcacaatattccttagttgacaaagagaagctgccaagattcccattttcaattgac

SEQ ID NO: 322476 - DNA, 4383 bp, Homo sapiens
acccggttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgagtaagctggggtcccgcggagtctccgccaggctccttcagctcgagctccctgggcgctcccctcccctcccgcactctgttcccttccctggaaggtgactttgactcagtcacattcgcttcagtcctacgggcgagtggacggagggcttgctgcggcagagccgtgcctcttcctggccaggcacgtatgcctgcgaggatagctcggattgaacggctacctggcgttgcagggagttagtagcccctgaaaattcatttgcaaattgcccgacaaaggtaaaaagatctttgactcttttgccaaactgaaagctgctattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggaaagtggaggttttttttgttggtttgtttgttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaatttgattatgtattataatgtaatctgtaaatagtgatatgattaacatcttaatcacatccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcattggccatgctatattcattcttttgagaattgctcattcatattttttctgttgcttgcttggagaatttgctctttttttggcatataagttcttaagaatgtccgtcctttgtcatatattgtaactttttttagccttatttgtcatttaacatagtttgtggtatttcagtatagaagttgttttctttaggagtctacctttgtgtatgtgcttgaaagtatttttgtaatccaagaatggataaatgtccttattttcttctagtattttcttatttcacttttacacctatctttaaaaggaatttaaattttgtttatatacattaactaaatcagtacaagtttggggtgaaaaggaaatttttaatccatctcaaatgtatttggttatattatataaggtagggatttgattttatttcgaagaatttaccaattggttcagtatgtgaaaccaccatttcccctctgattagtaatgctatttttatagaatattaaattcttatgtgtcttttgtgtcttaggccaatttctgggccttctgggttttttctacactgtcaataattatcgctttaattggtgttaatatttggtagtacacaggttctcccttgttcttttaaattttgtgaaatataacttacaaataagtacttaaaacagagcttaatgggtaaagcaacagctgtgtaatcacaaactagatgcagaggaggtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaaatagaataatactaaaaaaaagtgtt

SEQ ID NO: 322477 - DNA, 4075 bp, Homo sapiens
acccggttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgaaaaattcatttgcaaattgcccgacaaaggtaaaaagatctttgactcttttgccaaactgaaagctgctattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggaaagtggaggttttttttgttggtttgtttgttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaatttgattatgtattataatgtaatctgtaaatagtgatatgattaacatcttaatcacatccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcattggccatgctatattcattcttttgagaattgctcattcatattttttctgttgcttgcttggagaatttgctctttttttggcatataagttcttaagaatgtccgtcctttgtcatatattgtaactttttttagccttatttgtcatttaacatagtttgtggtatttcagtatagaagttgttttctttaggagtctacctttgtgtatgtgcttgaaagtatttttgtaatccaagaatggataaatgtccttattttcttctagtattttcttatttcacttttacacctatctttaaaaggaatttaaattttgtttatatacattaactaaatcagtacaagtttggggtagggatttgattttatttcgaagaatttaccaattggttcagtatgtgaaaccaccatttcccctctgattagtaatgctatttttatagaatattaaattcttatgtgtcttttgtgtcttaggccaatttctgggccttctgggttttttctacactgtcaataattatcgctttaattggtgttaatatttggtagtacacaggttctcccttgttcttttaaattttgtgaaatataacttacaaataagtacttaaaacagagcttaatgggtaaagcaacagctgtgtaatcacaaactagatgcagaggaggtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaaatagaataatactaaaaaaaagtgtt

SEQ ID NO: 322478 - DNA, 3657 bp, Homo sapiens
acccggttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgagttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggaaagtggaggttttttttgttggtttgtttgttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaatttgattatgtattataatgtaatctgtaaatagtgatatgattaacatcttaatcacatccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcattggccatgctatattcattcttttgagaattgctcattcatattttttctgttgcttgcttggagaatttgctctttttttggcatataagttcttaagaatgtccgtcctttgtcatatattgtaactttttttagccttatttgtcatttaacatagtttgtggtatttcagtatagaagttgttttctttaggagtctacctttgtgtatgtgcttgaaagtatttttgtaatccaagaatggataaatgtccttattttcttctagtattttcttatttcacttttacacctatctttaaaaggaatttaaattttgtttatatacattaactaaatcagtacaagtttggggtgaaaaggaaatttttaatccatctcaaatgtatttggttatattatataaggtagggatttgattttatttcgaagaatttaccaattggttcagtatgtgaaaccaccatttcccctctgattagtaatgctatttttatagaatattaaattcttatgtgtcttttgtgtcttaggccaatttctgggccttctgggttttttctacactgtcaataattatcgctttaattggtgttaatatttggtagtacacaggttctcccttgttcttttaaattttgtgaaatataacttacaaataagtacttaaaacagagcttaatgggtaaagcaacagctgtgtaatcacaaactagatgcagaggaggtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaaatagaataatactaaaaaaaagtgtt

SEQ ID NO: 322479 - DNA, 4128 bp, Homo sapiens
acccggttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgaaaaattcatttgcaaattgcccgacaaaggtaaaaagatctttgactcttttgccaaactgaaagctgctattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggaaagtggaggttttttttgttggtttgtttgttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaatttgattatgtattataatgtaatctgtaaatagtgatatgattaacatcttaatcacatccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcattggccatgctatattcattcttttgagaattgctcattcatattttttctgttgcttgcttggagaatttgctctttttttggcatataagttcttaagaatgtccgtcctttgtcatatattgtaactttttttagccttatttgtcatttaacatagtttgtggtatttcagtatagaagttgttttctttaggagtctacctttgtgtatgtgcttgaaagtatttttgtaatccaagaatggataaatgtccttattttcttctagtattttcttatttcacttttacacctatctttaaaaggaatttaaattttgtttatatacattaactaaatcagtacaagtttggggtgaaaaggaaatttttaatccatctcaaatgtatttggttatattatataaggtagggatttgattttatttcgaagaatttaccaattggttcagtatgtgaaaccaccatttcccctctgattagtaatgctatttttatagaatattaaattcttatgtgtcttttgtgtcttaggccaatttctgggccttctgggttttttctacactgtcaataattatcgctttaattggtgttaatatttggtagtacacaggttctcccttgttcttttaaattttgtgaaatataacttacaaataagtacttaaaacagagcttaatgggtaaagcaacagctgtgtaatcacaaactagatgcagaggaggtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaaatagaataatactaaaaaaaagtgtt

SEQ ID NO: 322480 - DNA, 4314 bp, Homo sapiens
acccggttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgagtaagctggggtcccgcggagtctccgccaggctccttcagctcgagctccctgggcgctcccctcccctcccgcactctgttcccttccctggaaggtgactttgactcagtcacattcgcttcagtcctacgggcgagtggacggagggcttgctgcggcagagccgtgcctcttcctggccagaaaattcatttgcaaattgcccgacaaaggtaaaaagatctttgactcttttgccaaactgaaagctgctattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggaaagtggaggttttttttgttggtttgtttgttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaatttgattatgtattataatgtaatctgtaaatagtgatatgattaacatcttaatcacatccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcattggccatgctatattcattcttttgagaattgctcattcatattttttctgttgcttgcttggagaatttgctctttttttggcatataagttcttaagaatgtccgtcctttgtcatatattgtaactttttttagccttatttgtcatttaacatagtttgtggtatttcagtatagaagttgttttctttaggagtctacctttgtgtatgtgcttgaaagtatttttgtaatccaagaatggataaatgtccttattttcttctagtattttcttatttcacttttacacctatctttaaaaggaatttaaattttgtttatatacattaactaaatcagtacaagtttggggtgaaaaggaaatttttaatccatctcaaatgtatttggttatattatataaggtagggatttgattttatttcgaagaatttaccaattggttcagtatgtgaaaccaccatttcccctctgattagtaatgctatttttatagaatattaaattcttatgtgtcttttgtgtcttaggccaatttctgggccttctgggttttttctacactgtcaataattatcgctttaattggtgttaatatttggtagtacacaggttctcccttgttcttttaaattttgtgaaatataacttacaaataagtacttaaaacagagcttaatgggtaaagcaacagctgtgtaatcacaaactagatgcagaggaggtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaaatagaataatactaaaaaaaagtgtt

SEQ ID NO: 322481 - DNA, 4073 bp, Homo sapiens
acccggttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgaaaaattcatttgcaaattgcccgacaaaggtaaaaagatctttgactcttttgccaaactgaaagctgctattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggaaagtggaggttttttttgttggtttgtttgttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaatttgattatgtattataatgtaatctgtaaatagtgatatgattaacatcttaatcacatccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcattggccatgctatattcattcttttgagaattgctcattcatattttttctgttgcttgcttggagaatttgctctttttttggcatataagttcttaagaatgtccgtcctttgtcatatattgtaactttttttagccttatttgtcatttaacatagtttgtggtatttcagtatagaagttgttttctttaggagtctacctttgtgtatgtgcttgaaagtatttttgtaatccaagaatggataaatgtccttattttcttctagtattttcttatttcacttttacacctatctttaaaaggaatttaaattttgtttatatacattaactaaatcagtacaagtttggggtgaaaaggaaatttttaatccatctcaaatgtatttggttatattatataaggtagggatttgattttatttcgatgctatttttatagaatattaaattcttatgtgtcttttgtgtcttaggccaatttctgggccttctgggttttttctacactgtcaataattatcgctttaattggtgttaatatttggtagtacacaggttctcccttgttcttttaaattttgtgaaatataacttacaaataagtacttaaaacagagcttaatgggtaaagcaacagctgtgtaatcacaaactagatgcagaggaggtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaaatagaataatactaaaaaaaagtgtt

SEQ ID NO: 322482 - DNA, 1475 bp, Homo sapiens
acccggttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgaaaaattcatttgcaaattgcccgacaaaggtaaaaagatctttgactcttttgccaaactgaaagctgctattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattg

SEQ ID NO: 322483 - DNA, 1941 bp, Homo sapiens
acccggttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgaaaaattcatttgcaaattgcccgacaaaggtaaaaagatctttgactcttttgccaaactgaaagctgctattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggggtagtctacctgggttaggtctacctgggttaggtctacctgggttaggtctacctgggttaggtctacctgggttaggt

SEQ ID NO: 322484 - DNA, 93 bp, Homo sapiens
ggagaggaactattgccaagcaccccaaaagttcaagaggtgactgttgatcccagagtagcaaggaaagggacagacaggctataagaagtg

SEQ ID NO: 322485 - DNA, 320 bp, Homo sapiens
tcctggttctaacactttctggctgagtaattttggggaagttacctaacctctctcagcttgtttctgtgaaactgtataactccaataaaatatggtgattgtgaaaataaaacaagaaaatacatgtaaaacaactggcaagttctaggcacacagtaaatactcaataaataataatatttatggagctgggcgcagtggctcacgcctgtaatcccagcactttgggaggccgaggcaggcggatcacgaggtcaggagatcgataccatcctggctaacacagtgaaaccccgtctctactaaaaatacaaaaa

SEQ ID NO: 322486 - DNA, 845 bp, Homo sapiens
gaggcgccgcggggcctcgtgcgccaacggtccctggtacgcggcggatgggcgccggcaggagcgggcagggcgaggcgaaggccggggagggatcgagaacggtgtgggagagctaggctcggggggcgaggccccggcccggcggggcgatggaggcgctgctctccacccccatcaaccccaacaacttccccgccaagctgtggcgcctggtgaacagcccgcgctaccgctccatccgctgggacggccgcggcgaggggctgcttatcgatcagccgctcttcgaggccgagctgctcagcccgcccgggccggggggcggtggcgggactgcgggggccggggccgagcccgagctcttcaaaaccaccagcttcaccagcttcatccgccagctcaacctctacggcttccgcaaggtggtgctgggcgggccggggggcggcaaaccggcaggcaatgggccgctccatcacttccacaacccgcacttccgccgcgaccagccacagctgctcgtgcacctcaagcgcctcaccagcgccaacaaggccaagctggcggccggcctggaggtgccctgccgcccgaccaaacggttccagcggctgctcatcacctcggcctccgccgccaccgcgccactgcagcaccagcagccgccgccgcccgcggggccccggcccgagccgcacggaccagtggctgtaggacaatttcaccggtcatttcgtcgagatagtttgtctccttactcctgtgtatcaactccatcccacgaccacagtacttaccctctgaaaggtttagatcggaccccagttcctcatagaatatgg

SEQ ID NO: 322487 - DNA, 557 bp, Homo sapiens
cctaaatatgatcagatccagggagcattgtgactgagttttcaggttagcctctgtgcaacctgacttcccatgggcagggtggagtgctgggagcattgattcaattcttcccttgagcactcttcacccccatctctctccagaaatgtaccgagagtctaactgctctatactctgggaggaacacgaacatgattccacctcagttccaagctttctgagaaccatcctgggaaccagcaagcatgacaactctccaccttctgcatcagtcacttgcaaggaggccagtgggcacagttcatgctactgagtgagatggcgcccagaggccaaggccaagggcagggctgcattttctggttcttttatatttgtagcaagatactcttagtggaagagcccaatatctgggcttgcctaaaagtctccttagctagatcattcaatttatgagctttccatcttgttgcagtgttgcttaatttctgcctctccataacaagaatcacctttcttccagtctctaatgcattgttctcactttcctataa

SEQ ID NO: 322488 - DNA, 844 bp, Homo sapiens
caatgaaagtagcctccacttacaaactaattactctttcttgaaaatattacactttttttcttctatatctctactcctagctctcaacacctttcttaagcccacatcataacctgtcttgcataactttgtgagtgcccaacgtttcactgtacaagattgtagagctgcatgcttcttaagaataaatccacactttaggtaccagtaaatccatgcaatgcctcagacgttataaccaaataatgcctggaaaatcgacatgaatttatgtgaagcataagcctttaatttttttaaagaaaagtagattgctgtttttccacatcatttcagagccgttctctagttttgcatgccctttactgcagaaccatacagattttgttctccatttcatacatcatttgttgaaatgccctttaaaatgtaacggaatatagagctttatgggaaaaaatgctgtagaaaataaattatcttctctctttgtattgggaaccaaaaggtctcaccttattaatgaccacagagactctcctaaagcaattctggaagtcaaaacagctggagtctagtttaatgggaaccctcattaattagacaagaacaccaaggctatgaccacagcagctggtagcagcagccctgcagtgaagtagactctcagaggacacaaggaaagagtgtattgataagaaatctacagcaaaggtgtagcacatcatcatttgatcttgatacacttgactgtgggcaaagtacctgttatgtaaaacatgctttgttagttagggccatgataagctgcttaagctgatgaatgaacaccaaatctcag

SEQ ID NO: 322489 - DNA, 331 bp, Homo sapiens
tggggaggctgatttgagtaataataaacctccatcctcctgtttggcagacttggagtcattaaaatctttctttactacaaaccaccatttcaatacatttgtgtgtgtgtgtgtgtgtgtgtgtgtgtgtgtgtgtgtgtgtgtgtgcaggaggccagaagaacttgtctggcaattataagagtggatggagaaactgcctatccctgtcccatggtcttgtccacaggtcagcctcacaaagggaaagagccctggatgggaatacagtggaaactcattctcttagtgacctggggacattggctctagaggaagcctggcagga

SEQ ID NO: 322490 - DNA, 830 bp, Homo sapiens
  misc_feature (91)..(91): n is a, c, g, or t
gcctgccggttaccgtccggatttcccgggtcgactactcctattaaattcgcggccgcgtcgaccccgaggcagggggatcacttgagcncaggagttcaaggccgggcaacatagtaagacccaccgtgctcagccaatgattcactttttaaagaaaacagcgttactgagatataattcacataccatacacatcacccgtttaaagtgtacagttaagtggttttgagtatattcaaagaattgttcagccatcaccacaatctaatcttagaacatttttatcacttgagaaagaaactccatacacatgagaagccatgtctgtttccaacctgcacacttccagctgtatgtaatcactaatctgctttctgactcaatagatttgcctattctgaagatttcatataaatgcaatcatacaatgtggtcttttgtgactggcttctttcacttagcatgttttcaaggttcatctatatggtagcatgtttccatactttattactgttacttgccaaataatactccactttgttatatatacattttgtttcattaattaatttcattaattgatggacatttcagtcatttccatttttggttactatgaaaatactgctgtgaacattcatatacaggtttatttttgtattcactcttgttttcctttcttttgattatgtagctaagtgtttaacatcattaggaactatcgaactgtttccaaagtacctgcaccattttatgttcccaccagcaatggataatggttcaaatttttccacatcctcaataacactttttgttgtgtcttttgt

SEQ ID NO: 322491 - DNA, 372 bp, Homo sapiens
cggggtcttactatgttgcccggccttgaactcctgggctcaagtgatccccctgcctcgggctctcaaaatgctgggattacaggcgtgacccaccgtgctcagccaatgattcactttttaaagaaaacagcgttactgagatataattcacataccatacacatcacccgtttaaagtgtacagttaagtggttttgagtatattcaaagaattgttcagccatcaccacaatctaatcttagaacatttttatcacttgagaaagaaactccatacacatgagaagccatgtctgtttccaacctgcacacttccagctgtatgtaatcactaatctgctttctgactcaatagatttgcctattctg

SEQ ID NO: 322492 - DNA, 369 bp, Homo sapiens
tcagtcggtacctcttgatgcaagtgtcacacaagagaaaatatttgctgttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccg

SEQ ID NO: 322493 - DNA, 417 bp, Homo sapiens
gtgctttcataaggctttgagagcatggtcttaatacgggatcattttctttttcctaatgaatttttgctaaaatagttttcagcaggtcatagctgacaggctttggttatcatttttagttcattcatcctcacacttctccctggccataattaaactaagacagtggaggaaagtcacactaaagaatgtgggtgagaaactaaatcaaggtttgtcttcagcctaacaatgaccatgttcttctcctgcagacggacagggttggaaaggcttttaagtacctggaagccgtcttgtccttcattgagtgcggaattgccacagagtctgaaagccagtcatccaagtcagcttactctgtctactcagaaactgtagatctcattaagtaagtgccgagtcattgtgctt

SEQ ID NO: 322494 - DNA, 1537 bp, Homo sapiens
ccttgtgcgaaatgagcccgggccgcagcaagcaacgaacccaagccagcagtgcccccctccagtgagaagaagaagcacaatgagctccctccctgccccctctaagtgctctctcagtgcccagaacccgcgaagggcaatgtggaggacaggacccctgagcactttgctcttgttcccctgactgagagccagtggcccaccccacagtggcagcggcagcaggactagtggctgcctgccaagcctgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctcccaaaagtgccagcagtaccaagagcaaccacaaagactcttccattcccaagcagagaagagtagaggggaagggctccagaagctcctcggagcacaagggttcttccggagatactgcaaatccttttccagtgccttctttgccaaatggtaactctaaaccagggaagcctcaagtgaagtttgacaaacaacaagcagaccttcacatgagggaggcaaaaaagatgaagcagaaagcagagttaatgacggacagggttggaaaggcttttaagtacctggaagccgtcttgtccttcattgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccg

SEQ ID NO: 322495 - DNA, 338 bp, Homo sapiens
ctaaactagggtagtagcagtgggcattaaaagaaagaaccactgcagaagtaaaaattacagggcctagtaataactggatgtgacagagaaaggagatggaagagtcaaaggttatactatagttcctatcctaaatagtaacatttagtgataacatttagaagaaatctttatctagtactttatcaaaacttcacaccaactaccaaatggttctcagagcattggaacaagacaacaagttttccacttggaaatactttttaaaataacatgtgtgtgtataattttttttttttttttttttttgaggcagggtctcgctgtcgcccagg

SEQ ID NO: 322496 - DNA, 631 bp, Homo sapiens
ccggctgcgggccagggtctgggaagggggtggtgggtcgccgtttcatcagaagccggaggacgggcgccagggggcaacttcctacaggagggcgtcccgttagaatgacagggcttttgcaaaagtctgacacccgtggcacagagcgccccagatatggagggtttcacagacagggtcgcagccgggcagaggtgctcctcacatcccagacggggcggcggggcagaggcgctccccacatctcagacgatgggcggcagggcagagactctcctcacttcctagatgtgatggcggccgggaagaggctcatgtgtggcttcttcagtcctctcttcattcactcatgtattcatttattcaacgacatattactaaggaacctccttaagccgggatgctgaacgtggaaaaatagttgactcttgaacaatgtgggggcttggggcaccaaccccctgtgcagttgaaaatcgacatataactttgactcgccaaaaacttcactacaatagcctgctgccaacctgaagtcttaccaataacatcaacagtcaattaaacatattacgtatgttatatgtattctatgctgtagttttacaataaagtaagctggagaaaa

SEQ ID NO: 322497 - DNA, 561 bp, Homo sapiens
ccggctgcgggccagggtctgggaagggggtggtgggtcgccgtttcatcagaagccggaggacgggcgccagggggcaacttcctacaggagggcgtcccgttagaatgacagggcttttgcaaaagtctgacacccgtggcacagagcgccccagatatggagggtttcacaggctcatgtgtggcttcttcagtcctctcttcattcactcatgtattcatttattcaacgacatattactaaggaacctccttaagccgggatgctgaacgtggaaaaatagatataattttacccctgagaagctcataggctaaaaaaaatattgatttgggataaatgtatgttaagttgactcttgaacaatgtgggggcttggggcaccaaccccctgtgcagttgaaaatcgacatataactttgactcgccaaaaacttcactacaatagcctgctgccaacctgaagtcttaccaataacatcaacagtcaattaaacatattacgtatgttatatgtattctatgctgtagttttacaataaagtaagctggagaaaa

SEQ ID NO: 322498 - DNA, 526 bp, Homo sapiens
ccggctgcgggccagggtctgggaagggggtggtgggtcgccgtttcatcagaagccggaggacgggcgccagggggcaacttcctacaggagggcgtcccgttagaatgacagggcttttgcaaaagtctgacacccgtggcacagagcgccccagatatggagggtttcacaggctcatgtgtggcttcttcagtcctctcttcattcactcatgtattcatttattcaacgacatattactaaggaacatataattttacccctgagaagctcataggctaaaaaaaatattgatttgggataaatgtatgttaagttgactcttgaacaatgtgggggcttggggcaccaaccccctgtgcagttgaaaatcgacatataactttgactcgccaaaaacttcactacaatagcctgctgccaacctgaagtcttaccaataacatcaacagtcaattaaacatattacgtatgttatatgtattctatgctgtagttttacaataaagtaagctggagaaaa

SEQ ID NO: 322499 - DNA, 493 bp, Homo sapiens
ccggctgcgggccagggtctgggaagggggtggtgggtcgccgtttcatcagaagccggaggacgggcgccagggggcaacttcctacaggagggcgtcccgttagaatgacagggcttttgcaaaagtctgacacccgtggcacagagcgccccagatatggagggtttcacaggctcatgtgtggcttcttcagtcctctcttcattcactcatgtattcatttattcaacgacatattactaaggaacctccttaagccgggatgctgaacgtggaaaaatagttgactcttgaacaatgtgggggcttggggcaccaaccccctgtgcagttgaaaatcgacatataactttgactcgccaaaaacttcactacaatagcctgctgccaacctgaagtcttaccaataacatcaacagtcaattaaacatattacgtatgttatatgtattctatgctgtagttttacaataaagtaagctggagaaaa

SEQ ID NO: 322500 - DNA, 773 bp, Homo sapiens
ccggctgcgggccagggtctgggaagggggtggtgggtcgccgtttcatcagaagccggaggacgggcgccagggggcaacttcctacaggagggcgtcccgttagaatgacagggcttttgcaaaagtctgacacccgtggcacagagcgccccagatatggagggtttcacaggctcatgtgtggcttcttcagtcctctcttcattcactcatgtattcatttattcaacgacatattactaaggaacctccttaagccgggatgctgaacgtggaaaaatagatataattttacccctgagaagctcataggctaaaaaaaatattgatttgggataaatgtatgttaagttgactcttgaacaatgtgggggcttggggcaccaaccccctgtgcagttgaaaatcgacatataactttgactcgccaaaaacttcactacaatagcctgctgccaacctgaagtcttaccaataacatcaacagtcaattaaacatattaccaggacaggcagaaggatgccttcttccacgcaagcactgaaccaaaccacagtagaagaaacagaatcaaatgagagagattcaactgaccagtttaaggcttatcagaaaggaacaaagacataccaaaatagaccatccttgcacaaacacagacacacagggacaaggcacaagtgcatcacttacaccagcacaggtgctagcaagaaacccattcatatgaacactttatgcggattttaaagggaaaactcttctttta

SEQ ID NO: 322501 - DNA, 237 bp, Homo sapiens
gcaacacagtaggaaggaatcacaggaggaaggaattacagcctaggtttcaaatcactcctccacctctaaaaagctacagtcaagttttataacctctctaaactttgttggtgacagcacagttcctaacacacactaggcctatgacatacatttgctgaatacaagaataatatttgtatgtagacctcacactctaagaggaagacaagtcattctttttttttttttttt

SEQ ID NO: 322502 - DNA, 467 bp, Homo sapiens
gggaatgaccctgagtcagggcagggccccctgacatctgcgtggaggtgatggcctgctccacccatgtggttggccctgcaggccacggccactgctccatgggtcacaggaccctctgtcccaccctctccaagtcatgctgcaggtgccagtgcagtcactgtccccaaacattgctgccctctgctcctggttccagagccctcaggggcttggtctgcctaccacatgggctggtacccagggctgaggctggccctgccctggcctgctggcttctacagcctcagaacaggtgtgggaagatgggggtggccccagtgcccaccagggcagcctgcccggtacctggtggtaatggagtatggtgtctgcattcacatccttccctggagatatgttgagccacaatttccgcatgaagtacacctggtaggggagcgtcacgggggcccctgggcgag

SEQ ID NO: 322503 - DNA, 768 bp, Homo sapiens
cgccctcctgaccgcagcggctagaggttccattgcagacccggaggccgtggctgtggttcgcggcggtgctgtcgcgggcgccctggcgcagcccacgcaggggctcctgaggggagacataagacatcagtcagtacatgtgaggtgtgcattggattgatccagaaagtcaggacgactccaagtggaaaggcctccagagacaggagacagtaaaagaaatggcctctctcctctgtcagagtggagtcccgagctcccagaaatgccacatgatggacaaacgcttgggggaaaaaaaaaaaaagggagacctcagtcgggacacaaaagcgggagctttaaaagaaaaaataagagataagttgaacttcaccaaaaaataagcgtttctggtcttggaaagacacttaaaatggaaagggcaagccatcgatgggggaaaatactcagaatagtgggatctgacagagggctgtatctagaatatatgaagatatttaaaatccagtaattggacataaagatggtacgccagcctgacacacaaaggaaccccaatggccaatgggacaggaagggaacccgtatggccgatggacagaaagggaagtgaacgtgaacatctcattggggatgccgttatcaccactggaatagtcaaaaacatggacaccaagtattggtgggtgagtggaatggcgggaacccacatacacggtcgatgggagctgcaccctttggaaatcatttcacagtttgtgc

SEQ ID NO: 322504 - DNA, 1371 bp, Homo sapiens
cctcaggatcagaaaaagagctggaaagggaaggggagtctacagaatatgaatttccccacaagacaccgctttgcggggccatttcaaaatttgtcaaagagatatattttggggtaaaatacattgatactttgagggcctgttgtcacgtgatgctataccagcgtcagattggaacttggtgtcttgctgctatggagtctgctgtcagtctggtcagctgcacctgaactccaaagggaggtgggtataatgagccatgtccaatccccgtcccttcctggcctgagctcatttttcaggttcttcagaatccccctggtggagatgagggatccattcagtgggttggggaagcttagagttttatttttgatttacactatgtgaagcagaaattaaaatactgtaaccctgatagggttattttaaagctgcaggaatcaaggcaggttgccgtcgggtaagaggatagacaggcaggtcatgtagcaggacgagctgcggacaaaacccctcagacaccaggttaaggaaggatttggctttattcggccgggagcttcggcagactcgcgtctcaagaaccgagctccccgaaaacagagttcctggcccttttaagggcttacacctctaaggggtccacgtgaaagggtcgtgatagattgagatcacatgtggttagagtgggagggggggtaatcttttaacctcaggcctggtcatcggtggcaccggctggtcttgctgctgacttcattcctgttgtttttcaacttttacttcatccttctcttcagagacaggagacagtaaaagaaatggcctctctcctctgtcagagtggagtcccgagctcccagaaatgccacatgatggacaaacgcttgggggaaaaaaaaaaaaagggagacctcagtcgggacacaaaagcgggagctttaaaagaaaaaataagagataagttgaacttcaccaaaaaataagcgtttctggtcttggaaagacacttaaaatggaaagggcaagccatcgatgggggaaaatactcagaatagtgggatctgacagagggctgtatctagaatatatgaagatatttaaaatccagtaattggacataaagatggtacgccagcctgacacacaaaggaaccccaatggccaatgggacaggaagggaacccgtatggccgatggacagaaagggaagtgaacgtgaacatctcattggggatgccgttatcaccactggaatagtcaaaaacatggacaccaagtattggtgggtgagtggaatggcgggaacccacatacacggtcgatgggagctgcaccctttggaaatcatttcacagtttgtgc

SEQ ID NO: 322505 - DNA, 937 bp, Homo sapiens
cacttccctgctcgatgtatgggccagcattgccttgatagcaaagtcagacatcaccagacagtagaaccacagaccaatgtctttcatgaaccaagacacagcatttaaaaaaattagcaaatggaatttatatctgcctattgtttacaaaaaaagccaaactttgtaaaatacttgaagagatttattctgagccaaatatgacccatgacacagcctcaggacgtcctgagaacttggcccaaggcggttgttttactgcttggttttattcatttcagggagacataagacatcagtcagtacatgtgaggtgtgcattggattgatccagaaagtcaggacgactccaagtggaaaggcctccagagacaggagacagtaaaagaaatggcctctctcctctgtcagagtggagtcccgagctcccagaaatgccacatgatggacaaacgcttgggggaaaaaaaaaaaaagggagacctcagtcgggacacaaaagcgggagctttaaaagaaaaaataagagataagttgaacttcaccaaaaaataagcgtttctggtcttggaaagacacttaaaatggaaagggcaagccatcgatgggggaaaatactcagaatagtgggatctgacagagggctgtatctagaatatatgaagatatttaaaatccagtaattggacataaagatggtacgccagcctgacacacaaaggaaccccaatggccaatgggacaggaagggaacccgtatggccgatggacagaaagggaagtgaacgtgaacatctcattggggatgccgttatcaccactggaatagtcaaaaacatggacaccaagtattggtgggtgagtggaatggcgggaacccacatacacggtcgatgggagctgcaccctttggaaatcatttcacagtttgtgc

SEQ ID NO: 322506 - DNA, 851 bp, Homo sapiens
cgccctcctgaccgcagcggctagaggttccattgcagacccggaggccgtggctgtggttcgcggcggtgctgtcgcgggcgccctggcgcagcccacgcaggggctcctgagggtcctgcgaggccgggaggtcctgggggtctgggaggtccctggggtcgggaagtcggtggaccctgcaggccagtggggaggggagacataagacatcagtcagtacatgtgaggtgtgcattggattgatccagaaagtcaggacgactccaagtggaaaggcctccagagacaggagacagtaaaagaaatggcctctctcctctgtcagagtggagtcccgagctcccagaaatgccacatgatggacaaacgcttgggggaaaaaaaaaaaaagggagacctcagtcgggacacaaaagcgggagctttaaaagaaaaaataagagataagttgaacttcaccaaaaaataagcgtttctggtcttggaaagacacttaaaatggaaagggcaagccatcgatgggggaaaatactcagaatagtgggatctgacagagggctgtatctagaatatatgaagatatttaaaatccagtaattggacataaagatggtacgccagcctgacacacaaaggaaccccaatggccaatgggacaggaagggaacccgtatggccgatggacagaaagggaagtgaacgtgaacatctcattggggatgccgttatcaccactggaatagtcaaaaacatggacaccaagtattggtgggtgagtggaatggcgggaacccacatacacggtcgatgggagctgcaccctttggaaatcatttcacagtttgtgc

SEQ ID NO: 322507 - DNA, 1411 bp, Homo sapiens
gagctggggacgtcccctggggcaccccagggcatgggtggcattgctttggcggctccgcagcctggcagatccaagggggcatagttgacagcaggcatcagcgtaggcgccgctgggtggctggtcagaggggacactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagcctta

SEQ ID NO: 322508 - DNA, 404 bp, Homo sapiens
atggaaggaataagggaagaggggggaagtgaaggttttgagcaataatctaatctatcacaatgtttctcctgttcttttctgaccatggggctccccttttctgggataagtagatttttggaccaccttgcttattcccttggggactgatcatgattcaccacatttgttctttgcagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagcctta

SEQ ID NO: 322509 - DNA, 273 bp, Homo sapiens
attcgcggccgcgtcgacaggtcttacaaatggaaccccgtttgtaagttgttagttgagctcaactaacaacttctaccaaggacccctggatcgacccactggccctttggtggcctaaagaattcccctctggaggaaactacaactgcagggccccttctttgcccctatccagccaggaagtgcttctaaagtcagaacaggttctccaaggatcccctcgagactactctgttaccagtcatgaaacattaaaacctacaagcctta

SEQ ID NO: 322510 - DNA, 1718 bp, Homo sapiens
  misc_feature (1717)..(1717): n is a, c, g, or t
cgcctctggggttttatattgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagccttaaaaaaaaaaaaaaaaaaaaaaacaaaaaaaactggggggcgcgcgcgccttgggcccgtggaaaaggttttaaagaaccattccggtagggcgcgcgcgggggccccaggggggaagagggagacactggggacaaagagggtggtcccagaggggaaacccggggcacaaggaacaaagggcggggggaattctccacacacaatatataaaaaagagcgccgggggggcacaaccaggagagaggttctggtgaaacaaaatctatccagagagaggggagctccgagagaggacaaatagaggggacctcttatatacaaagaggagagcccaacagggaagaccacaagttatcaaattaaaggccccgccgcgggggagnc

SEQ ID NO: 322511 - DNA, 1548 bp, Homo sapiens
caaagggatgtcgaggcacccaagagccagcaacagagggagctctcacacccctaaacatgaaggggtcaggtgacgagggcagtgtcattggagcttagtgagagcttgagctctgaaagaggggctgcccaacaggaactgtgctcatggagggccacgccattgtcaggaaatagaccctgacttcttttgccctcctactttccagcctcttgcaggaatcttctatcagccaaatatagccagaagccagaaagcaatgaacacttgagtgatacaatgtgccttgcatcactcagtgcacaaaggcaggggagagactgtaggagagtgaagaggagggaaggtcaaatggaaataatgaacacatagaaaatactggttccaggtctgagtcctacctggggccctgttgagaaggagtataccctttaaatgtcaatcagaaatttccagggctgaccattctcctctccagatccatcccatcctgtgtaacatggtgccacactctcccagcatgagaatgtcaatgagaattttccagccattgggagtctgccaggctcatatggcttttgtctccaccagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagcctta

SEQ ID NO: 322512 - DNA, 1673 bp, Homo sapiens
cgcctctggggttttatattgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagccttaaaaaaaagaagaaaaaaaaaagaaaacaaaaacattgtgttggcgggcgccctgggcccaggggaaaagggtttctaagcccccccttggggtggggcgccggcgggccgccaataggtatatggtgcacacacatgtggccaactaagcgctgtgctcccaaagagaaaactccggcgacatagacaaagggtgtgtggatttttccaccacaaattaaaaaacgccccggggggacacaccggcgtgttctggtgaacacaccccgaatgggagttccggagggcaccgggggtcacacacagggggcccaaaaaacccgaataaaattcgcacggtgt

SEQ ID NO: 322513 - DNA, 1320 bp, Homo sapiens
cgcctctggggttttatattgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacagagtagtctcgaggggatcttggagaacctgttctgactttagaagcactgtcgac

SEQ ID NO: 322514 - DNA, 1339 bp, Homo sapiens
cgcctctggggttttatattgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccagggtgacagccatcacctgaatccaggacgatgcctgtcgtgcggccagaggcatagagggagagcacagcttgaatggcgacgtacatggcagggacatt

SEQ ID NO: 322515 - DNA, 968 bp, Homo sapiens
  misc_feature (967)..(967): n is a, c, g, or t
ctactactactaattcgcggcgctcgactggccatctcattctcaaaatccagggccacatagcaagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagccttaaaaaaaaaaaaaaaaaaaaaaacaaaaaaaactggggggcgcgcgcgccttgggcccgtggaaaaggttttaaagaaccattccggtagggcgcgcgcgggggccccaggggggaagagggagacactggggacaaagagggtggtcccagaggggaaacccggggcacaaggaacaaagggcggggggaattctccacacacaatatataaaaaagagcgccgggggggcacaaccaggagagaggttctggtgaaacaaaatctatccagagagaggggagctccgagagaggacaaatagaggggacctcttatatacaaagaggagagcccaacagggaagaccacaagttatcaaattaaaggccccgccgcgggggagnc

SEQ ID NO: 322516 - DNA, 1108 bp, Homo sapiens
  misc_feature (1107)..(1107): n is a, c, g, or t
cgcctctggggttttatattgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaagcaggaagtgcttctaaagtcagaacaggttctccaaggatcccctcgagactactctgttaccagtcatgaaacattaaaacctacaagccttaaaaaaaaaaaaaaaaaaaaaaacaaaaaaaactggggggcgcgcgcgccttgggcccgtggaaaaggttttaaagaaccattccggtagggcgcgcgcgggggccccaggggggaagagggagacactggggacaaagagggtggtcccagaggggaaacccggggcacaaggaacaaagggcggggggaattctccacacacaatatataaaaaagagcgccgggggggcacaaccaggagagaggttctggtgaaacaaaatctatccagagagaggggagctccgagagaggacaaatagaggggacctcttatatacaaagaggagagcccaacagggaagaccacaagttatcaaattaaaggccccgccgcgggggagnc

SEQ ID NO: 322517 - DNA, 722 bp, Homo sapiens
cgcctctggggttttatattgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaagcaggaagtgcttctaaagtcagaacaggttctccaaggatcccctcgagactactctgttaccagtcatgaaacattaaaacctacaagcctta

SEQ ID NO: 322518 - DNA, 518 bp, Homo sapiens
  misc_feature (15)..(15): n is a, c, g, or t
  misc_feature (24)..(24): n is a, c, g, or t
  misc_feature (72)..(72): n is a, c, g, or t
gataaccttgcccantctggcaantgagcgcttccgctggaagagggtctcagggcagcggaacgtcatcanaatgggttgataacctgcccatctggcagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagcctta

SEQ ID NO: 322519 - DNA, 1317 bp, Homo sapiens
cgcctctggggttttatattgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaaggtatctgtagacttccccttaatgagcctgctttaatgatcacccatcgtcatgaccctcgtattcataggccactgtgctctgtcaactctccctgtaaaatgcttctcacttctgtctttcctttcttttcagccccacgaccatttctccaacctaggctgccaacatctctccctggactattgcaatggcttcctggctgatttcttggtctcttgccctcatcctaccagaattaattctctacactgctgcaaaactgatctttctaaacacagatcagctcatgtcactcacctcctcagaaatcttcagtagctcttcattaaccaacagggggttcctaactccccgtcttggcattggaggacctttccctgcctgatccccgcgatcatcttttcctgaaatatttactcaggccagtgctcaccccttctttaaaatgctggtgctggctcaagagaggcaaacagccatctctctcattcttatcttccctgtcaagacttcacataggtggactgatgctagactatgatgatgagtctccagtgaaagtttctaagtagaactctctcagggtttctagaagcatttttgtttaagaaaatattgtggggagagcgggatttttaaatggtggagctcatggtaaacaaaattatgtgtgcaaaatgttaatagagcctttctaatattcttgtgattaactctggtgacagttggctgagtgttcttgtttctgcaacgcctgtctttggaaatgtgatagggggcttattgagcagactgcaactggaaatgaggaatgttgacttgaagtctgtaattcacttatacttttctctaaatcctagactgagtcactcaatgtgagataagtactgcacataaaatgcaatggatttcacgttatacagtggagtgggtaag

SEQ ID NO: 322520 - DNA, 661 bp, Homo sapiens
cgcctctggggttttatattgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtagttacggccaaacccttggacaaggaaggcaaccacccagccctagctcacaggaggctcccctaaatcccaaggcccaaagcaagggggggcaacacagcaattgaacccagaatcactgttctgaaaccttcaatgtccctgaccaatgggtaacgatcagcccattcaaagctgatgctctccacttcctaattgccttctgggccagcacgacagggcatacgtccatgggggactattaccaag

SEQ ID NO: 322521 - DNA, 558 bp, Homo sapiens
cgcctctggggttttatattgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagcaggaagtgcttctaaagtcagaacaggttctccaaggatcccctcgagactactctgttaccagtcatgaaacattaaaacctacaagccttatctacagtcagaacaggtccccccagcatcccctcgagactactctgtcaccactcatgaaacactacaacctacaagccttacac

SEQ ID NO: 322522 - DNA, 411 bp, Homo sapiens
aggaagacttgaacactggcataagaatgcaacatggatgcttggccagatactttctccccttcaaacatcagtgcaacagaactctctgaggacctgctatgtctgtggtccatgccaggccctgggggagtgggtgtggaataatgaactatcaaactggcatagttcctgcccttaatgagattacaaaccattctacaggccaagaagtgctgtgatttttgccaaataatcttttattcttcattgtcctttaagatcatgtttgaaaccttcaatgtccctgccatgtacgtcgccattcaagctgtgctctccctctatgcctctggccgcacgacaggtgagtaatcctgtaatccattccttttctgacttcaggggaggtagggaaaagctggggtctgg

SEQ ID NO: 322523 - DNA, 1332 bp, Homo sapiens
cgcctctggggttttatattgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagcctta

SEQ ID NO: 322524 - DNA, 1238 bp, Homo sapiens
  misc_feature (19)..(19): n is a, c, g, or t
gtttagtacttagaggatncgatcagtgcatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagcctta

SEQ ID NO: 322525 - DNA, 1332 bp, Homo sapiens
aaacgatcagtacacaatcagtgggagacgaggctctcataccctcggtggctcataggtcctcaagtggcatctcattgagcgagatcattgcatgtttaatagatggatagcatcgtgctcgtgtgtgaaagtcgcggtcgggactgtagccgtgctgaggctacgtcacgaattgattgcccccgcacggtgattgatcttccactctcactattgtggacgctgccactcgcacgatcaagatgtgatgatgcgcgcactgcgcgtgagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagcctta

SEQ ID NO: 322526 - DNA, 1041 bp, Homo sapiens
cgcctctggggttttatattgctctggtattcatgccaaagacacaccagccctcagtcactgggagaagaacctctcataccctcgatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagcctta

SEQ ID NO: 322527 - DNA, 1542 bp, Homo sapiens
cgcctctggggttttatattgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagccttaacttctctgtgtggggctcttttttcctgggctatgtctcatacacagtgctaaggacttttcacacattacttttaatccatgcaataatgctgtaaggtaggtgctatcattatacccatattacagatgaggaaattgaggctcagagaagtcaaggacttgcgaagatcacacagattccagattaaaattcaagtatctgactgc

SEQ ID NO: 322528 - DNA, 1261 bp, Homo sapiens
  misc_feature (1257)..(1257): n is a, c, g, or t
cgcctctggggttttatattgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccaactgggatgacatggagaagatctggcaccactccttctacaatgagctgcgtgtagacctgaagagcaccccaccctgctcacagaggctcccctaaatcccaaggccaacagggagaagatgacccagatcatgtttgaaacctttcaatgtcccttgccattgtacggtcgccatttcaagcttgtgctcttccctcttatggccttttgggcgnaaaa

SEQ ID NO: 322529 - DNA, 526 bp, Homo sapiens
gatccccggttggctactagtccacggttggctactagtccacggttggctactagtccacggttggctactagtccgcggttggctactagtccgcggttggctactagtccacggttggcgcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagcctta

SEQ ID NO: 322530 - DNA, 636 bp, Homo sapiens
cgcctctggggttttatattgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggacttcaggtgatggggtcacccacaatggcacgtggatcgggtaccgagc

SEQ ID NO: 322531 - DNA, 1182 bp, Homo sapiens
cgcctctggggttttatattgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagccccacgaccatttctccaacctaggctgccaacatctctccctggactattgcaatggcttcctggctgatttcttggtctcttgccctcatcctaccagaattaattctctacactgctgcaaaactgatctttctaaacacagatcagctcatgtcactcacctcctcagaaatcttcagtagctcttcattaaccaacagggggttcctaactccccgtcttggcattggaggacctttccctgcctgatccccgcgatcatcttttcctgaaatatttactcaggccagtgctcaccccttctttaaaatgctggtgctggctcaagagaggcaaacagccatctctctcattcttatcttccctgtcaagacttcacataggtggactgatgctagactatgatgatgagtctccagtgaaagtttctaagtagaactctctcagggtttctagaagcatttttgtttaagaaaatattgtggggagagcgggatttttaaatggtggagctcatggtaaacaaaattatgtgtgcaaaatgttaatagagcctttctaatattcttgtgattaactctggtgacagttggctgagtgttcttgtttctgcaacgcctgtctttggaaatgtgatagggggcttattgagcagactgcaactggaaatgaggaatgttgacttgaagtctgtaattcacttatacttttctctaaatcctagactgagtcactcaatgtgagataagtactgcacataaaatgcaatggatttcacgttatacagtggagtgggtaag

SEQ ID NO: 322532 - DNA, 770 bp, Homo sapiens
tagaggatccgtagtgctttgggacggcgtcgctgggcggctacccggttcttctgcttcttcagctgcctttgttgctccttggggtctgtctgggtcagcagcccattgcccccacagaggtgcatggttaggcgggggagcagagtggtccctcagcagctgtgacttcccagtgccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaatacccaggaagtgcttctaaagtcagaacaggttctccaaggatcccctcgagactactctgttaccagtcatgaaacattaaaacctacaagccttaacttctctgtgtggggctcttttttcctgggctatgtctcatacacagtgctaaggacttttcacacattacttttaatccatgcaataatgctgtaaggtaggtgctatcattatacccatattacagatgaggaaattgaggctcagagaagtcaaggacttgcgaagatcacacagattccagattaaaattcaagtatctgactgc

SEQ ID NO: 322533 - DNA, 414 bp, Homo sapiens
cgaagctcgttcttccgccagcttccctcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322534 - DNA, 381 bp, Homo sapiens
ggatcccccgggctgcaggctcgtgccttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322535 - DNA, 406 bp, Homo sapiens
  misc_feature (33)..(33): n is a, c, g, or t
ttggatccgaattcggatccaacgttggatccnccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322536 - DNA, 423 bp, Homo sapiens
  misc_feature (4)..(4): n is a, c, g, or t
  misc_feature (67)..(67): n is a, c, g, or t
tgtnattgttccataataaacttctggtgtgatactttcaaaaaaaaaaaaaaaaaaaaaaaaaaanctcggactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322537 - DNA, 480 bp, Homo sapiens
  misc_feature (454)..(454): n is a, c, g, or t
cgaagctcgttcttccgccagcttccctcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaaaaacaaaaaaacaaaaaaaacaacaacacccccncccccaaaccacaccacaacaaaaaa

SEQ ID NO: 322538 - DNA, 654 bp, Homo sapiens
  misc_feature (29)..(29): n is a, c, g, or t
  misc_feature (40)..(40): n is a, c, g, or t
  misc_feature (244)..(244): n is a, c, g, or t
  misc_feature (258)..(258): n is a, c, g, or t
cagagaagcggtgtcttgacttaagtctntctgttctgtnggcaagtaaatgcagtactgttctgatccggctgctattagaatgcattgtgaaacgactggagtatgattaaaagttgtgttccccaatgcttggagtagtgattgtgaaggaaaaaatccagctgagtgataaaggctgagtgttgaggaaatttctgcagttttaagcagtcgtatttgtgattgaagctgagtacatttngctggtgtattttnaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322539 - DNA, 854 bp, Homo sapiens
gggctgcaggaattcggcacgagctccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaaaaaaaaaaaaaaaaaaaaaaaaaaaaaaaaaaaaatttggccggaaaggggggaaaatggtgccccgggcggcatcggggtaatctggaaacaagaagaagcgccgaactgaagaactctagggaaccgcggcgttaacattgcgcgtggaaggggcgcaaacaaaagccctcacagggatgaccccctaaaaggggggggggccctgaagaccagccgtgggtgggaaggggggagcccaactatatctgccgtgagaaattgcgggaaaccctctgcctgtaggcaaaacgacattcgagaaaaatcaccatcagtggggcccaggacaccaggtggctcacaccctggtaaatcccgcgccaattgtggggagagggcccagggacaaaaaggattggtctgtgcccccaggggaagttttgaaaaaccagtccgggggccacttgggggagacccctattcctggggaaga

SEQ ID NO: 322540 - DNA, 453 bp, Homo sapiens
agcggccgcctactactactaaattcgcggccgcgtcgaccttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaagaaagaagatgaggaaaaaaggtcgacgcggccgagttgtattaaaggtttcga

SEQ ID NO: 322541 - DNA, 388 bp, Homo sapiens
gcgtcgacgtttcttggccaggaatcgcttaatcctgaaagtcttgtgagaagacatggcgagcagcggagtcaagaacacaccacgatggcggagaaaggaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322542 - DNA, 971 bp, Homo sapiens
  misc_feature (4)..(4): n is a, c, g, or t
  misc_feature (67)..(67): n is a, c, g, or t
tgtnattgttccataataaacttctggtgtgatactttcaaaaaaaaaaaaaaaaaaaaaaaaaaanctcggactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttcggtttgtgtatttccccctttcactggggcccttccaaacacaatgaatgaaggaaatatcattttttaagcaggctatcagtgatggcattagactgtgataccgttctttatatagaaccaggatggctcggcaattttagcaaaaatggttatgctcctggggagactaacagtttgtcgcacgtgatagctaaatggacaggaagcaggagccgaggattaccggcaagggccccgcaaaaaggccggggggtggggataccccgggggatgggggggaccacacctcgacacaggcagggataaccacctccatatcctgttgcctaaaacatatttatcca

SEQ ID NO: 322543 - DNA, 630 bp, Homo sapiens
ctctaatattgtctaaattgattgcattttcttcccagtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaaaaaaaaaaaaaaaaaaaaaaaaacccggggcaccaatgcgggggtcgggacaaaaaatacggtattcatttaacatctggggcccactgtcgggcataatagccactgttatccctgagcacccaacgacattgccgtggtcaccacaacggtgtgatcaaaatacacggcgaggtaactcccctattcaggagagacgccaatctaattatcgcaaataacaccccaggttttaacccggcaattaagaacc

SEQ ID NO: 322544 - DNA, 269 bp, Homo sapiens
agcggccgcctactactactaaattcgcggccgcgtcgacgtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322545 - DNA, 279 bp, Homo sapiens
  misc_feature (13)..(13): n is a, c, g, or t
  misc_feature (15)..(16): n is a, c, g, or t
  misc_feature (18)..(19): n is a, c, g, or t
  misc_feature (50)..(50): n is a, c, g, or t
gcggcggctactncnncnnctactactactaaattcgcggccgctcgacngtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322546 - DNA, 241 bp, Homo sapiens
  misc_feature (13)..(13): n is a, c, g, or t
  misc_feature (15)..(16): n is a, c, g, or t
  misc_feature (18)..(19): n is a, c, g, or t
  misc_feature (50)..(50): n is a, c, g, or t
gcggcggctactncnncnnctactactactaaattcgcggccgctcgacntgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322547 - DNA, 188 bp, Homo sapiens
gcggccgcctactactactactactgctcgaattcaagcttctaacgatgtacggggatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322548 - DNA, 475 bp, Homo sapiens
cggcgaccacgacagcccccacaatcccggggatcacgcctggggcgtcggcctcttccccttctttcctgtggctgcctccaccatcacctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322549 - DNA, 650 bp, Homo sapiens
agcggccgcctactactactaaattcgcggccgcgtcgacgcgagaagacgacagaaggggcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaaaaaaaaaaaaaaaaaaaaaaaaaaaaaaaaaaaaaaaaaaaaaaaaaaaaaaaaaaaaaaaaaaaccgggcgggcgcgcgcgcgcaagagactccagacaagcgcggggtgaccggaggccaaaaaaaagagaacacaaagcaaagaagaggagggacccaaaaaaaacacgagagaagaacaggggggggatccac

SEQ ID NO: 322550 - DNA, 371 bp, Homo sapiens
ctctaatattgtctaaattgattgcattttcttcccagtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322551 - DNA, 373 bp, Homo sapiens
gggctgcaggaattcggcacgagctccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322552 - DNA, 851 bp, Homo sapiens
  misc_feature (494)..(494): n is a, c, g, or t
agcggccgcctactactactaaattcgcggccgcgtcgacgcgagaagacgacagaaggggcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaaaaaaaaaaaaaaaaaaaaaaaaattttgggggggcttgggncctggaaaaagtttttttagaacacattggtgtggggggcggggggcccagagggacacgggacactgtggccaaaacggggcccaaggaaaaccggggcagacaaagggcgggttctcacccaaataaaaaaacccccgggggaaaacgaaaaggtttctgagaaacaaaatccccaagggagaacaagagagggcacaaaacgaggggactctctattaaccagggaggtctcccaagggcagaccgccgaatatcccaatatagcccgggtctgcgtctgcagaaagaacggcaagcgagagagagaagacaaaagagcagaacaaaagacggaagacaaacacagacagagaa

SEQ ID NO: 322553 - DNA, 896 bp, Homo sapiens
agcggccgcctactactactaaattcgcggccgcgtcgacgcgagaagacgacagaaggggcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaacaaaaaaaagaaaaaaaaaaaaaaaaaaacaaaacaaaaaaaaaaaaaaaaaaaaaaaaaaaaaaaaaaacaaaaaaaaaaaaaaaaaaaaaaaaaaaaaaaaaaagaaggggggggcgcgcccccaaaaatctatcacgcaggggggcgacacaacaagatgcagccacactgtgtgtacaagagaggggcccccaaagagggggcactataaaaacacgaacagcgcggcggggcggcgcggccctaaaaaaaaacaaggcggatagagggaaaacaaagaccatccgatgagggaacgaagtcgaggagaaacaaacaacaccaccacagggaggggggggagaacaaaacaaggagagaggaacaccaaccaacacagagaaataaaacacctcagcgagaggaaaaaaaaaaaacgacgagcaagaagaggggcgaac

SEQ ID NO: 322554 - DNA, 1613 bp, Homo sapiens
agcggccgcctactactactaaattcgcggccgcgtcgacgcgagaagacgacagaaggggcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaacaaagaacaagaaaaaaaaaaaaacaaaaaaaaaaaaacaaaaaaaagaaaaaaaaaaaaaaaaaaacaaaacaaaaaaaaaaaaaggggggggggccccaaaaaaacaccctccgagaggagggagcggccaaatattcacatgcgacaacaccgaaatatgtcggtagaaaccaagagagggggcgccccccaatagaggagaggcagccgattaataataaaaacgagagcgagagagcggcagacgagctaaaaaaaacacagccggggcgaggcggggagacaaacaacgtacccaacgggggacactcatcgtgagaggaagcaccaccaccacaaccaccgggggggcgggcggacaaacacacatgtagcggggagacacaacacaacactcccgcaacagagaagaaatgaacgacccaccgcgcgacgagagagaaaaacataaaaacacaactcaggagaagtcgagcatatgatctgcgggggggacaacacacccgcacgccaagaatatagcgcgcgaggcaccgcgatgaaaaacaagaacgatgctggccgcagcgagaagaaatatctaagcgaagaaaaacaactaccttatcacgagcgggcggcgctgtctcctctgctctatctaacactaacgtggtagaacaaaagacgagaaagacaaaagaaaaagatcgaagcacgagagacgacaacagataacagaagaagagaaagagcaagcaaagcggatgaagaaggatagacagaaggattcagaagagaagaagataaacagaaagaagaggaaacaaacagacagaatgataaagatcaaacagtagaaagaaacaacacgagaacaagaaacacgaaaagaaaaaacaaagagaggagcgcgcagccccccgcgcaacgacggcacacgcagagcagaccggacgcagcagaggagcaaacaggacgagagggaagaaaggaggaagaagaagggaggaaagaggaagacagagacaaacagagcgagagcagaggagagaaaagaacggaaccatgaaaagaacagacggatactacaagagcgagagacgaaagaggaagcacgagagacaagcagagagagaagacagcaacagacgagactccgagagggacggaagagag

SEQ ID NO: 322555 - DNA, 585 bp, Homo sapiens
  misc_feature (18)..(18): n is a, c, g, or t
  misc_feature (20)..(21): n is a, c, g, or t
  misc_feature (23)..(23): n is a, c, g, or t
cggacgcgtgggtcgacncnngngtcgcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaaaaaaaaaaaaaaaaaaaaaaaaaaaaaaaaaaaaaaaaaaaaaaaaaaaaaaaaaaaaaaaaaaaccgggcgggcgcgcgcgcgcaagagactccagacaagcgcggggtgaccggaggccaaaaaaaagagaacacaaagcaaagaagaggagggacccaaaaaaaacacgagagaagaacaggggggggatccac

SEQ ID NO: 322556 - DNA, 986 bp, Homo sapiens
  misc_feature (986)..(986): n is a, c, g, or t
agcggccgcctactactactaaattcgcggccgcgtcgacgcgagaagacgacagaaggggcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaaaaaaaaaaaaaaaaaaaaaaaaaaaaaaaaaaaaaaaaaaaaaataaaacaagagaggggggcggcgcactctaagaaaggttccccccccgagggggggacagatgcttcgtcgacgctacccaagttttgttgtgaacacagggggccccaaatagtagggaggggccgagtaatataaggcaaagaggaacacggcgcccggcggttaaaacacaacgcgctcagcaagatgggagaaacacgtccgaacgggtgaggtacatcttgtcggagagaagaaacccttacttgtcggggggggcggacatatagtgggcgaaaaaacactccccacgtcgagagaatattaaagcaccgtcgagagaaacaatattaaacatttcagagggcttcttatgtgtggtttataaccaaccggcgaaattagtaggtcgcggcagtagaaaaaaatttgtggctcagaagaaggaatatttagtatttggggaaatatttttatttccgcggggggctgttattaatatatagan

SEQ ID NO: 322557 - DNA, 843 bp, Homo sapiens
agcggccgcctactactactaaattcgcggccgcgtcgacgcgagaagacgacagaaggggcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaaaaaaaaaaaaaaaaaaacaaaaaaaaaaaaaaaaaaaaaaaaaaaaaaaaaaagaaggggggggcgcgcccccaaaaatctatcacgcaggggggcgacacaacaagatgcagccacactgtgtgtacaagagaggggcccccaaagagggggcactataaaaacacgaacagcgcggcggggcggcgcggccctaaaaaaaaacaaggcggatagagggaaaacaaagaccatccgatgagggaacgaagtcgaggagaaacaaacaacaccaccacagggaggggggggagaacaaaacaaggagagaggaacaccaaccaacacagagaaataaaacacctcagcgagaggaaaaaaaaaaaacgacgagcaagaagaggggcgaac

SEQ ID NO: 322558 - DNA, 540 bp, Homo sapiens
  misc_feature (35)..(35): n is a, c, g, or t
  misc_feature (39)..(39): n is a, c, g, or t
  misc_feature (511)..(511): n is a, c, g, or t
  misc_feature (538)..(538): n is a, c, g, or t
caccccagccaaaaggccagctcctcccgagagcntgtntctaaaaagcaggaggcagaagggcccggaatccagaagagcagggtgaagtcagtaaggcagccgcgccgacgcacaacgagggcacactgccgacggccacagtcctctccaccagagcctcttccctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcccccgggggaaaacggtttcctctctaatctgtataaacgnttttttttttttggaggttttttgggngg

SEQ ID NO: 322559 - DNA, 625 bp, Homo sapiens
  misc_feature (35)..(35): n is a, c, g, or t
  misc_feature (39)..(39): n is a, c, g, or t
caccccagccaaaaggccagctcctcccgagagcntgtntctaaaaagcaggaggcagaagggcccggaatccagaagagcagggtgaagtcagtaaggcagccgcgccgacgcacaacgagggcacactgccgacggccacagtcctctccaccagagcctcttccctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgtgaacacgttggttggctggactcaggaacaaatatcgaaggcctttctttttaccaccaccaacccaatatcctcccaccttctccccccctcctcctcctctccaccctgtccacccaccacaacatttgcccccccctccgccactccgtctttacctccccacctctatctccccccc

SEQ ID NO: 322560 - DNA, 1456 bp, Homo sapiens
agaaccaagctgggtctataaggaattgcacatgattttatttccagttttcatccgaatccactggggaatgggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaacaaaaaaaagaaaaaaaaaaaaaaaaaaacaaaacaaaaaaaaaaaaaggggggggggccccaaaaaaacaccctccgagaggagggagcggccaaatattcacatgcgacaacaccgaaatatgtcggtagaaaccaagagagggggcgccccccaatagaggagaggcagccgattaataataaaaacgagagcgagagagcggcagacgagctaaaaaaaacacagccggggcgaggcggggagacaaacaacgtacccaacgggggacactcatcgtgagaggaagcaccaccaccacaaccaccgggggggcgggcggacaaacacacatgtagcggggagacacaacacaacactcccgcaacagagaagaaatgaacgacccaccgcgcgacgagagagaaaaacataaaaacacaactcaggagaagtcgagcatatgatctgcgggggggacaacacacccgcacgccaagaatatagcgcgcgaggcaccgcgatgaaaaacaagaacgatgctggccgcagcgagaagaaatatctaagcgaagaaaaacaactaccttatcacgagcgggcggcgctgtctcctctgctctatctaacactaacgtggtagaacaaaagacgagaaagacaaaagaaaaagatcgaagcacgagagacgacaacagataacagaagaagagaaagagcaagcaaagcggatgaagaaggatagacagaaggattcagaagagaagaagataaacagaaagaagaggaaacaaacagacagaatgataaagatcaaacagtagaaagaaacaacacgagaacaagaaacacgaaaagaaaaaacaaagagaggagcgcgcagccccccgcgcaacgacggcacacgcagagcagaccggacgcagcagaggagcaaacaggacgagagggaagaaaggaggaagaagaagggaggaaagaggaagacagagacaaacagagcgagagcagaggagagaaaagaacggaaccatgaaaagaacagacggatactacaagagcgagagacgaaagaggaagcacgagagacaagcagagagagaagacagcaacagacgagactccgagagggacggaagagag

SEQ ID NO: 322561 - DNA, 1515 bp, Homo sapiens
ggccatgtcttctcataatgactttcagtggattgaagacgagtatgcctggtcgcaagtaagacacatggcacaatatccgttgcccacttcgcaccagatggtattctgtgatagcaaaagctggtaaaattacaatcaggttaccaccttccagatagaggtacgacaattaggtatgacagataccaacgatgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaacaaaaaaaagaaaaaaaaaaaaaaaaaaacaaaacaaaaaaaaaaaaaggggggggggccccaaaaaaacaccctccgagaggagggagcggccaaatattcacatgcgacaacaccgaaatatgtcggtagaaaccaagagagggggcgccccccaatagaggagaggcagccgattaataataaaaacgagagcgagagagcggcagacgagctaaaaaaaacacagccggggcgaggcggggagacaaacaacgtacccaacgggggacactcatcgtgagaggaagcaccaccaccacaaccaccgggggggcgggcggacaaacacacatgtagcggggagacacaacacaacactcccgcaacagagaagaaatgaacgacccaccgcgcgacgagagagaaaaacataaaaacacaactcaggagaagtcgagcatatgatctgcgggggggacaacacacccgcacgccaagaatatagcgcgcgaggcaccgcgatgaaaaacaagaacgatgctggccgcagcgagaagaaatatctaagcgaagaaaaacaactaccttatcacgagcgggcggcgctgtctcctctgctctatctaacactaacgtggtagaacaaaagacgagaaagacaaaagaaaaagatcgaagcacgagagacgacaacagataacagaagaagagaaagagcaagcaaagcggatgaagaaggatagacagaaggattcagaagagaagaagataaacagaaagaagaggaaacaaacagacagaatgataaagatcaaacagtagaaagaaacaacacgagaacaagaaacacgaaaagaaaaaacaaagagaggagcgcgcagccccccgcgcaacgacggcacacgcagagcagaccggacgcagcagaggagcaaacaggacgagagggaagaaaggaggaagaagaagggaggaaagaggaagacagagacaaacagagcgagagcagaggagagaaaagaacggaaccatgaaaagaacagacggatactacaagagcgagagacgaaagaggaagcacgagagacaagcagagagagaagacagcaacagacgagactccgagagggacggaagagag

SEQ ID NO: 322562 - DNA, 470 bp, Homo sapiens
cactactctgatcctagttaagagcctagccttcaaattattttgagaggataaaacttgacttggctagtttttaaacacatagggaattattttttttactctccagaaagaactccaaacttgttagaggagagaaaagcagtaccctttgtattttgtggtacctaaaaggttatgtgaatgggaacagctacattgctgtcagactgcctttgtaacttgacatttttttctgtgtaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttt

SEQ ID NO: 322563 - DNA, 395 bp, Homo sapiens
agcggccgcctactactactaaattcgcggccgcgtcgaccttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322564 - DNA, 457 bp, Homo sapiens
  misc_feature (12)..(12): n is a, c, g, or t
  misc_feature (21)..(21): n is a, c, g, or t
catcgacccccnttggcacgngccgcgcgccattgcgttgatacccgcgaattcggccattatggccggggcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322565 - DNA, 552 bp, Homo sapiens
  misc_feature (35)..(35): n is a, c, g, or t
  misc_feature (39)..(39): n is a, c, g, or t
caccccagccaaaaggccagctcctcccgagagcntgtntctaaaaagcaggaggcagaagggcccggaatccagaagagcagggtgaagtcagtaaggcagccgcgccgacgcacaacgagggcacactgccgacggccacagtcctctccaccagagcctcttccctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322566 - DNA, 407 bp, Homo sapiens
agcggccgcctactactactaaattcgcggccgcgtcgactcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322567 - DNA, 382 bp, Homo sapiens
  misc_feature (18)..(18): n is a, c, g, or t
  misc_feature (20)..(21): n is a, c, g, or t
  misc_feature (23)..(23): n is a, c, g, or t
cggacgcgtgggtcgacncnngngtcgcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322568 - DNA, 721 bp, Homo sapiens
  misc_feature (33)..(33): n is a, c, g, or t
ttggatccgaattcggatccaacgttggatccnccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaaaaaaaaaaaaaaaaaaaaaaaaaaaaaaaaaaaaaaaaaaaaacaaaaacaagggggggagaggaaaacaagaccagacacagagagcggacaaagagaaagagcaacacacgcaaggggaggagacaaaacacggggacgctaagaagaggcgcgcaacaaaaacaaaaaaacccaggagaacgcagtaaaagaaggacgagagagggaagacagagggaaaaacggggacaaattaggggaaaagacaaaccaaaccgaagaaggagggagacaaacaaaaaacagaaaacaaaacacagcaaacag

SEQ ID NO: 322569 - DNA, 447 bp, Homo sapiens
agcggccgcctactactactaaattcgcggccgcgtcgacgcgagaagacgacagaaggggcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322570 - DNA, 801 bp, Homo sapiens
  misc_feature (35)..(35): n is a, c, g, or t
  misc_feature (39)..(39): n is a, c, g, or t
caccccagccaaaaggccagctcctcccgagagcntgtntctaaaaagcaggaggcagaagggcccggaatccagaagagcagggtgaagtcagtaaggcagccgcgccgacgcacaacgagggcacactgccgacggccacagtcctctccaccagagcctcttccctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaccgggcgggcgcgcgcgcgcaagagactccagacaagcgcggggtgaccggaggccaaaaaaaagagaacacaaagcaaagaagaggagggacccaaaaaaaacacgagagaagaacaggggggggatccac

SEQ ID NO: 322571 - DNA, 478 bp, Homo sapiens
gcccggccgctgccgagtcgggcagggattccggtttcccttcgcttgtagcgaactcgttctggaggcggggggtgggaggtggcagccacccccgaaatcgtggcctgactgtgggctgcccgtggcatgcgcaacgtggaggtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaa

SEQ ID NO: 322572 - DNA, 802 bp, Homo sapiens
  misc_feature (743)..(743): n is a, c, g, or t
  misc_feature (753)..(753): n is a, c, g, or t
  misc_feature (791)..(791): n is a, c, g, or t
agcggccgcctactactactaaattcgcggccgcgtcgacgcgagaagacgacagaaggggcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaagactctcagaaactgctacaccagctgaatgccctgttggaacaggagtctagatgtcagccaaaggtctgtggtttgagactaattgagtctgcacacgataagggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgaactgttttatttggctgnaaatcaattnaagaggaaaggaatgtccattggcactgacttgatccnataagcaatat

SEQ ID NO: 322573 - DNA, 772 bp, Homo sapiens
agcggccgcctactactactaaattcgcggccgcgtcgacgcgagaagacgacagaaggggcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaaaaaaaaaaaaaaaaaaacatgtcgtgcggctcggctcagcccagtctagtctagactaggctaaggtatgcgatgcgaacgcaagctgagttgactagtccaacctatcgtatggcgagttacattacactgcactgcgctttacatcacagcgactggaatgacaatgccgtgacgcaacttaattgaattgcattgcatcacattttcgtttggtgaggtgatatggggaatgtgaatggcgagctgtaatgttaagttaagcgtcgagttattgttaattagctcagtttattaccaaccgacaggccgagatagt

SEQ ID NO: 322574 - DNA, 696 bp, Homo sapiens
agcggccgcctactactactaaattcgcggccgcgtcgaccttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaaaaaaaaaaaaaaaaaaaaaaaaaaaaaaaaaaaaaaaaaaaaaaaaaaaaaaaaaaaaaaaaaaaaaaaaaaaaaaaaataaatttattaaataaaaaaaaaaatcacgggccggcgttttacaacgttgggactgggaaaaccctggcggttccaaatttaattgccttgaagaaaatccctttttgccagttggcgaataaccaaaagggccccaccgatcgcctttccaaaaattgcccaccctgaatggcaaatggcaaattgaagccgttaattttgggtaatccgcgttttgtgg

SEQ ID NO: 322575 - DNA, 628 bp, Homo sapiens
  misc_feature (35)..(35): n is a, c, g, or t
  misc_feature (39)..(39): n is a, c, g, or t
caccccagccaaaaggccagctcctcccgagagcntgtntctaaaaagcaggaggcagaagggcccggaatccagaagagcagggtgaagtcagtaaggcagccgcgccgacgcacaacgagggcacactgccgacggccacagtcctctccaccagagcctcttccctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcagctcttgaagatgatgtgtctcagagtttgttccttcagatgttcagatatgtccagagtttcttccttccagtgggttcgtggtctcactgacttcaggaatgaagctgcatacgctcacgctccacagaaaagttctccaagtccccactcgacccaggaagtcctgctgtcttcacctgtcaccagctactggggaggctgaggcaggagaatcgcttgaacccaggaggtggaggttgctgggagccaagccaagatcacgccactacactccagcctggcaacagagtgagactccgtctc

SEQ ID NO: 322576 - DNA, 1044 bp, Homo sapiens
aaacaagatagtttatttctcttcatgtaaaaatttgaatgacaatttagtgaaggtgacaagggcccacgcttctgctaaggtccaggcattcctagagtggtatatgatagatcatatggtataagatagatcacttccatagccacagagtatccagttattaatacaaacaaatgagaagaggaaggggagagcaagtctttctttgtttttagagcacaatccagaagttgaattcctatcttagtcacattaaattggctagagtatcgttacgtagtcagacctagagttgcaaaggagactgaaaaaatgcagtttaatctgaacagccatgtgtccaggtaaaaattctgttattagggaagaaagagagaatgaatattgggaaacactttcaaagacctcccaccaccaaagtacctacctaaatattttatcttcctatgtttgtgtgaggtattgaggttttataaatgtgcacataattttgcaattgtatttttatttatattacacagtaagaaaaacagaatgttctatatttatagtcttcctgttacaaatatgcgattagagcttaaagagtcatagtatcagaattagaatgttaatattcccactcaatatactgaggtctcattttcattatggtgggtttactaactgccccatatacttcgcagggctgctttgaagctaaaatgagatcattcatatgggatcacattaagctgctagaaattagaaaatgtacatgagatagtataaattttacagtcactaatttaagtttcttttcattagacgctgttggaagctctgactgtggcagttgttggtaagccgtaactgcatttctatatgttataataactttttaatgtagatagatctttcaggtaaaaaggtatttggggctaaagtttaacatcatggaatatcatatttcagaaatatagcataggacaaataatttctaaagtataagcaaaagttagatatttatcgtttacatatttcagctgagcttagaagtgg

SEQ ID NO: 322577 - DNA, 612 bp, Homo sapiens
cgtgatagctctccagtcatttcattaacttggtaataatgtgacctctgattttgtatgaatgaattttttggagactgttaattgcattatgggtgtggtttcactgtacccatgtagtcaaggatggataagaaatcttttctaattgtttttattggcataaagtacaggagaaaatgaagcatttctataaaatgccagaaaaagctgttttgtattgagcatgtttatatgcatgttaatcagtgttttaattttacagttactttctatgatgtatatattattctgcaagctttcatactgactactacagtattttttggtttgactgtgtatactctacaatctaagaaggatttcagcaaatttggagcagggtaagttgtatatattcttggatataatagatagatgtctttaattattataggtggttttgaggaatgtgctacactgttatttttgggtactgtcttttaaaatggagggtaataagagatcatctctttgagtactagggccaggtcctactcctagaacatacacagaaatggaaagtggctttgacttatttgcttctctcctatagtgaaagggaagtgaatt

SEQ ID NO: 322578 - DNA, 515 bp, Homo sapiens
  misc_feature (34)..(34): n is a, c, g, or t
  misc_feature (42)..(42): n is a, c, g, or t
cgcggccgcgcgacacggctgcgagaagacgacngaagggcnaaaaaaaaaaaaaccctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatggtaatgtggttagaggacaccaaagatactgggtcatcagccattaagtatatctatttcaaaattaaaatatttgggaagtattgtc

SEQ ID NO: 322579 - DNA, 1597 bp, Homo sapiens
acggcttgctcggcctgggctcttcctcgcggaagtggggaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagtttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaatttaacgagaaaaaggattaaagtaattggaagcagtatatagaaactgtttcattaagtaataaagtttgaaacaatgattaaaaaaaaaaaaaaaaaaaaaaaaaaaaaaaaaaaaaaaaaaaaaaaaaaaaaaaaaaaaaaaaaaaaaaaaaaaaaaaaaaaacaaaagggggagggcaagcacacacatcagcgcaacgaaacagatcgagagcaacagagaggagcacacagcagcagaaaaaacgtactgaaaagagacctcagaacacaagaggcgacagagaagagagcaagggagagaaaaaggagaagaaagaagcgggggagacaaaagaaaaaagagaagaaacaagagagagagaaagagagagagaacacaaaaaaggaagcaaaaaaaaagcagagagagacacaaaagaggaaaaaaaggagaaagaggaaaaaacgaaaaaagggggagacccccacagacgaaaaaaaaaaatagagggaggaatgacaaacaggggagaggcgcgagacacgagccgggcgagaggtactaaggaaagaaacgagcacccaccagagacaaacgaaacggagaagcgcgccgcgaacaacgagcggaacaaccccaagaggagcgcaagatagaaaaggaagaccgaacagaggggacaaccagccagagaccaaaaggccaccaacaaaacgggaagaacgacggccgcggggaatgcacatggaggataggagcagaca

SEQ ID NO: 322580 - DNA, 1820 bp, Homo sapiens
  misc_feature (27)..(27): n is a, c, g, or t
cctggtggcgaattcggcacgagggangaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagtttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaatttaacgagaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatggtaatgtggttagaggacaccaaagatactgggtcatcagccattaagtatatctatttcaaaattaaaatatttgggaagtattgtc

SEQ ID NO: 322581 - DNA, 2775 bp, Homo sapiens
acggcttgctcggcctgggctcttcctcgcggaagtggggaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatgggtacgttgtcccctctccagtgcctcccagccgcttgtctgcactgctcggcctctagaagccgacttccggcttccgagggagagcggccatctcctgggactcacagggagtgctcactgagctcccggccctccttctccgggtaccagaggactggcgccctcctcagggagtcggggaggcgcttcctcccctcctagcgggtgtgggagggcgccaggcccagaaggcttgcggctgtcctgtgtgcgccccggctccccagcgggcgccgcggtgtaggaagggacagatggaaaccgccgcagcctgaatttggcatcttgaagtgaaaagaaacgtcgtggaaatgagtcggttgatcactgtgactgacgtacacacgagtggaatccacggcctgatgtttttgttctgtggggtttcgcgttacaggcttatatttaccgtcctgtgctaggctggaagctccctgacggcactatttcctctccgcagggcccagaatgcaacaggtctttgaggattattgaggaagttgctcaacacagaagcttcctaagtcagtctaaattgtgttttaagttattacgtagtagccaatgggcagaaatttttgaatttaaaatgctcagcttcatctacgtggaagccattgcctgctctagtttggtcatttgatcgccgaaacagccccagactttcagcctgtttaggcagctggaacttgttctggaaaaggaaagatgaagatagttctgatgtgctaagaatcttagtgcctagaacttgttctggaaaaggaaagatgaagatagttctgatgcaccaagaatcttggtgcctagcatttatatttttggaattgaattttgaaattattttggccagtgaactcagcttttttttaaaaaaaattaattgtggtaaaatacagcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagtttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaatttaacgagaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatggtaatgtggttagaggacaccaaagatactgggtcatcagccattaagtatatctatttcaaaattaaaatatttgggaagtattgtc

SEQ ID NO: 322582 - DNA, 2395 bp, Homo sapiens
acggcttgctcggcctgggctcttcctcgcggaagtggggaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaaggtaagttatgttataatggttaatttgaaatataattctggctgtgtcaatataaataacctcaaaaagctataagagatactcttatgataggacacttagttataattatccagaacatttgtatatagaatgattatagaattatccctttagaaaatcagggtcttgtgttggtccttattattgactgaaaaaaagatgaatgaataaatgaattaaattacatagaaagaggcccttgcttacaactgccaagctccagtggcacatttaattgtgaaaaacgaaatatatttttaaataatttatatgtggaatgctgtttttcaaagtgggtaatttagtttaatggaatataaccactcattcatccttccatccaacagaggcaagtttggacttgccttgcctttttctgcttttaacatttgtattcaaagttgtacaccattgtcaaatgtataatgtagcagtaaatcattagaggaagtaagttaagtcctgttaatactgttctcaaatataaacatatttctttaatctcttccctatagttttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaatttaacgagaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatggtaatgtggttagaggacaccaaagatactgggtcatcagccattaagtatatctatttcaaaattaaaatatttgggaagtattgtc

SEQ ID NO: 322583 - DNA, 2241 bp, Homo sapiens
aaacaagatagtttatttctcttcatgtaaaaatttgaatgacaatttagtgaaggtgacaagggcccacgcttctgctaaggtccaggcattcctagagtggtatatgatagatcatatggtataagatagatcacttccatagccacagagtatccagttattaatacaaacaaatgagaagaggaaggggagagcaagtctttctttgtttttagagcacaatccagaagttgaattcctatcttagtcacattaaattggctagagtatcgttacgtagtcagacctagagttgcaaaggagactgaaaaaatgcagtttaatctgaacagccatgtgtccaggtaaaaattctgttattagggaagaaagagagaatgaatattgggaaacactttcaaagacctcccaccaccaaagtacctacctaaatattttatcttcctatgtttgtgtgaggtattgaggttttataaatgtgcacataattttgcaattgtatttttatttatattacacagtaagaaaaacagaatgttctatatttatagtcttcctgttacaaatatgcgattagagcttaaagagtcatagtatcagaattagaatgttaatattcccactcaatatactgaggtctcattttcattatggtgggtttactaactgccccatatacttcgcagggctgctttgaagctaaaatgagatcattcatatgggatcacattaagctgctagaaattagaaaatgtacatgagatagtataaattttacagtcactaatttaagtttcttttcattagacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagtttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaatttaacgagaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatggtaatgtggttagaggacaccaaagatactgggtcatcagccattaagtatatctatttcaaaattaaaatatttgggaagtattgtc

SEQ ID NO: 322584 - DNA, 2546 bp, Homo sapiens
tgtcctgtgctgtttgctgtccagtgtccaagaactgttgtttcatatattttgtctggttttatttaaggaaggaggataaatgtggcctctgtaattccctgtgacctgaagcagctgataagtcccatattttataacaaaagactgacttcttagatgtcctttcttatataatttatactctctatatataacaattgaattgtaactcataaaattatagcagtgtcagatgtgtccatcaattaagttccataatacataagaataaaatggaaagtacattgtgaacttcgatagacatgttcacagaataacttgttattacttggtttaaaagtgcaatcctagttcatttgtttatatattttctaaaagtttttatagatctctgaattaaaatacttgtaatgatatttctgcttttatctgtattttatgttccaaaacttcacaaattatactgttaactaggtttgtataccataaagacaaatgttgaataaatagctgttctttcaatttctttaaaaaaaagatccaagatgggcattatattcattgtatgtttacaaattcttacattttagttattcttcagcaaaaaatccagatggatgtttttttcagaaagtgttgaatgggtttacaaagtttttttgtaaggaacaatattgcaaattactaaaattgtatttttataggctgtttgctcttttgtggatattgtgcctgtcaggattcttgaaggtaagttatgttataatggttaatttgaaatataattctggctgtgtcaatataaataacctcaaaaagctataagagatactcttatgataggacacttagttataattatccagaacatttgtatatagaatgattatagaattatccctttagaaaatcagggtcttgtgttggtccttattattgactgaaaaaaagatgaatgaataaatgaattaaattacatagaaagaggcccttgcttacaactgccaagctccagtggcacatttaattgtgaaaaacgaaatatatttttaaataatttatatgtggaatgctgtttttcaaagtgggtaatttagtttaatggaatataaccactcattcatccttccatccaacagaggcaagtttggacttgccttgcctttttctgcttttaacatttgtattcaaagttgtacaccattgtcaaatgtataatgtagcagtaaatcattagaggaagtaagttaagtcctgttaatactgttctcaaatataaacatatttctttaatctcttccctatagttttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaatttaacgagaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatggtaatgtggttagaggacaccaaagatactgggtcatcagccattaagtatatctatttcaaaattaaaatatttgggaagtattgtc

SEQ ID NO: 322585 - DNA, 412 bp, Homo sapiens
ttcctaagtcagtctaaattgtgttttaagttattacgtagtagccaatgggcagaaatttttgaatttaaaatgctcagcttcatctacgtggaagccattgcctgctctagtttggtcatttgatcgccgaaacagccccagactttcagcctgtttaggcagctggaacttgttctggaaaaggaaagatgaagatagttctgatgtgctaagaatcttagtgcctagaacttgttctggaaaaggaaagatgaagatagttctgatgcaccaagaatcttggtgcctagcatttatatttttggaattgaattttgaaattattttggccagtgaactcagcttttttttaaaaaaaattaattgtggtaaaatacaggtaacataaaatttaccgtcttaactattt

SEQ ID NO: 322586 - DNA, 1835 bp, Homo sapiens
acggcttgctcggcctgggctcttcctcgcggaagtggggaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagtttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaatttaacgagaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatggtaatgtggttagaggacaccaaagatactgggtcatcagccattaagtatatctatttcaaaattaaaatatttgggaagtattgtc

SEQ ID NO: 322587 - DNA, 2689 bp, Homo sapiens
  misc_feature (27)..(27): n is a, c, g, or t
cctggtggcgaattcggcacgagggangaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatgggtacgttgtcccctctccagtgcctcccagccgcttgtctgcactgctcggcctctagaagccgacttccggcttccgagggagagcggccatctcctgggactcacagggagtgctcactgagctcccggccctccttctccgggtaccaggcccagaaggcttgcggctgtcctgtgtgcgccccggctccccagcgggcgccgcggtgtaggaagggacagatggaaaccgccgcagcctgaatttggcatcttgaagtgaaaagaaacgtcgtggaaatgagtcggttgatcactgtgactgacgtacacacgagtggaatccacggcctgatgtttttgttctgtggggtttcgcgttacaggcttatatttaccgtcctgtgctaggctggaagctccctgacggcactatttcctctccgcagggcccagaatgcaacaggtctttgaggattattgaggaagttgctcaacacagaagcttcctaagtcagtctaaattgtgttttaagttattacgtagtagccaatgggcagaaatttttgaatttaaaatgctcagcttcatctacgtggaagccattgcctgctctagtttggtcatttgatcgccgaaacagccccagactttcagcctgtttaggcagctggaacttgttctggaaaaggaaagatgaagatagttctgatgtgctaagaatcttagtgcctagaacttgttctggaaaaggaaagatgaagatagttctgatgcaccaagaatcttggtgcctagcatttatatttttggaattgaattttgaaattattttggccagtgaactcagcttttttttaaaaaaaattaattgtggtaaaatacagcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagtttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaatttaacgagaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatggtaatgtggttagaggacaccaaagatactgggtcatcagccattaagtatatctatttcaaaattaaaatatttgggaagtattgtc

SEQ ID NO: 322588 - DNA, 1797 bp, Homo sapiens
acggcttgctcggcctgggctcttcctcgcggaagtggggaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatgggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagtttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaatttaacgagaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatggtaatgtggttagaggacaccaaagatactgggtcatcagccattaagtatatctatttcaaaattaaaatatttgggaagtattgtc

SEQ ID NO: 322589 - DNA, 587 bp, Homo sapiens
cccccgggctgcaggattcggcacgagagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322590 - DNA, 829 bp, Homo sapiens
  misc_feature (676)..(676): n is a, c, g, or t
  misc_feature (715)..(715): n is a, c, g, or t
cccccgggctgcaggattcggcacgagagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaaaaaaatataaataaaaaaataataaataataaattaaaaaataaaataaaaaatttatatattatatttaaaaattaatattantgtattttttttaaaatattattataattatattatatnttttttttaaatttaatttttaaaaaataacttgaggggggccaaaacccacatttttccttataggagacttttttacattcggttcccacttttaaacaccctaatttggga

SEQ ID NO: 322591 - DNA, 644 bp, Homo sapiens
  misc_feature (491)..(491): n is a, c, g, or t
  misc_feature (530)..(530): n is a, c, g, or t
cgccctcctagtgtaaaaaaacggcacgagagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaaaaaaatataaataaaaaaataataaataataaattaaaaaataaaataaaaaatttatatattatatttaaaaattaatattantgtattttttttaaaatattattataattatattatatnttttttttaaatttaatttttaaaaaataacttgaggggggccaaaacccacatttttccttataggagacttttttacattcggttcccacttttaaacaccctaatttggga

SEQ ID NO: 322592 - DNA, 734 bp, Homo sapiens
ggtgacctagagttacgtcgacggaagcgggaaaggtaagaccttggaatgttttgattgatcatcacttttctgatagaccttctctaaaatcccataatgtaccaaagagagagttaggctccgagctaccagaatccatcccaaaacgtgttgccaggcagctcccaagtagaacaggtcggcagatccatgcacccctcctgtccctcccgcacctgcacagccgctgtggccctgagcctgcggcccccctcggagctccgggtggaacctgtttttaccacctcagctccactgtgctttgactgtgtttcctgttgattgaaaggactttcccttcactgaccaccatgtcattatttctctgtcttcctcatgcaggggagaggactgtccctgagcagatttagctgggtaggtgacgaacgcacttccatcggcttcctcttccgtcccagtcctcacagccccgcaacttttgtgttctgctctgtttcggttgcttcctggcctccttttctctcctctcgagacctctctgcccacagctgggatcgggccgccttgtcttccactggggaaatgaaacgtggtcttcccttccggaaggtctggtctcttgcttctgtgccggggacccagccctgcaaggccagatcctcttctcccagagggttcccaggcgacgtgactggtctccctcccagggagggagcaacaccacgtccgag

SEQ ID NO: 322593 - DNA, 2059 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322594 - DNA, 2038 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaagcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322595 - DNA, 2401 bp, Homo sapiens
  misc_feature (2231)..(2231): n is a, c, g, or t
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaaaaaacgcgcctttcgcgcttctgccgtggccctctgcgggccgctccgccggtgctgtccctgggcgcctccgtgctctcagccaaccgcctctgagagcgcccactcgagcgccccgggagccagagggcggnggtcctcgccgggacccttctgtgggcccagggggtgagcagggcagcatttccttctcccactgctgctgagatggcagaaattagtcgaattcagtacgaaatggaatatactgaaggcattagtcagcgaatgagggtcccagagttagtagtagcccgcccgctgc

SEQ ID NO: 322596 - DNA, 2334 bp, Homo sapiens
  misc_feature (2181)..(2181): n is a, c, g, or t
  misc_feature (2220)..(2220): n is a, c, g, or t
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaaaaaaatataaataaaaaaataataaataataaattaaaaaataaaataaaaaatttatatattatatttaaaaattaatattantgtattttttttaaaatattattataattatattatatnttttttttaaatttaatttttaaaaaataacttgaggggggccaaaacccacatttttccttataggagacttttttacattcggttcccacttttaaacaccctaatttggga

SEQ ID NO: 322597 - DNA, 2413 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaaaaaaaaaaaaaaaagggacatgaggaattttgatacaagcatgtaatgcttattaatcacatcatggaacacagggtatccatcccctcaagcgtttatcctttatattataaacaatctaattctacccttttcattattttaaagtacacaattaagttattattaactatagttaccctgttgtgctatcaaatactaggtaaatttgatcctattttcttgtacccattagccatcaccctcttcctccaagcaccccactacccttcctagcttctgatgactgtgcttctattctctatgtccatgagtt

SEQ ID NO: 322598 - DNA, 2585 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaaaaaatgagaattccaaaatgccattcaaagagtcttggtcagggaggaaaactaatagggctgcagttcacaaatcaaaacacgagggcccgcaccaagattcattgatcgcagccttgggaatgaaactggggtcttcaaagtgggttgtgacaatctggcaacctttgaaaccctttgcttattcccagttggcttcccttgttagaaagagcactttgaaagaaaaccggcgaatttcatagtgtgggctcacacatttcaaggtggctaccattaagggggcacccttggggtgatccccgtgccacctttagtggggcccattggtcacggtgtgaaagtcccgatagtggatgaaggttctaactcggttccaaagcgcccaaataatggtgtccaattggcgcctgccaaacgggcgccgccggacctttaccctcgggcccatcctcttgcacatgcggcaccactccctcggggttgct

SEQ ID NO: 322599 - DNA, 2058 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322600 - DNA, 2041 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagagctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322601 - DNA, 2037 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacactgaggtcggctctgcgatccatacgtggccgcacccacacagcacgtgctgtgacgatggctgaacggaaagtgtacactgttcctgaatattgaaataaaacaataaacttttaatggta

SEQ ID NO: 322602 - DNA, 2030 bp, Homo sapiens
  misc_feature (1917)..(1917): n is a, c, g, or t
  misc_feature (1921)..(1921): n is a, c, g, or t
  misc_feature (1932)..(1932): n is a, c, g, or t
  misc_feature (1934)..(1935): n is a, c, g, or t
  misc_feature (1941)..(1941): n is a, c, g, or t
  misc_feature (1954)..(1954): n is a, c, g, or t
  misc_feature (1958)..(1958): n is a, c, g, or t
  misc_feature (1960)..(1960): n is a, c, g, or t
  misc_feature (1963)..(1963): n is a, c, g, or t
  misc_feature (1965)..(1965): n is a, c, g, or t
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacagntacncgggaggctgngnngggagnactgcttgaaccngggngncanangttgcggtgggccgggatcgcgccactgcactccagcctgggcaacagagtgagactctgtctca

SEQ ID NO: 322603 - DNA, 1892 bp, Homo sapiens
  misc_feature (1865)..(1865): n is a, c, g, or t
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcacacnttatggagggatcctctagaacaccca

SEQ ID NO: 322604 - DNA, 2004 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaaagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322605 - DNA, 1908 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacgacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322606 - DNA, 1323 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322607 - DNA, 1854 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaaccaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322608 - DNA, 1410 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccagagagcgtcaccccacagagagagcgtcacccccaacagagagagcgtcggtacc

SEQ ID NO: 322609 - DNA, 1188 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322610 - DNA, 3917 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaagaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaactctgctatggggtccagagtctaggagtggtttctgcagttgattgtcagtggagaacctgtggctgctggttcatcaaagcgctggtccctgagtgccattcagattgcagatgcagtattttacgtgatgtttagagtgtttggtggttgtgtaattttggagagaaagaagtttttcccaaaaaagtccctagtttattgggtgttctcacacaacctgtaagatgaagctgtttttctgcctgtgtgcagggctgattctggaattccagaaggccttgtgggagcgtaaaaggcttttgaataaagtgtggaacagagcgcctcattctgataacatgcaatcataaaaaccatagggcaacttggagttaaggagtttctagaatttgctttagtctccaactgcaattctttattgatcatgaaattgttgaagagaaacacaaatgtcagttttacctttcctgtgggcgtgaaagcacatcgaagtttcaggcaactgttaacatctctaccatctgtctgagttgagatttcaggttgtgacacttgccgtgacttatttgtaaatgacattttgtgtgtcttagatactaatggaattcatattctggctagttctttcagtgcatttgtagacatgttcttttcctttgtagcagtcctccctcaccctgaaatgttggtgttctaaccgatttctaatgctaatttcaactggaagcactttttcaagcccagctatcaaaccacaccagacatgtatggattcgggttgcccaataaagcgttgctattatgtaagcatccctcacgcatacagcatcaccagttttgaaagcttgaactattctgcttacttcaaggtacagaaaaaaaaaatgtacttaaactgtgcagaaaagatgaaatcactggataatatgtattataaaataagcttcatgtgagtgacactggtttaagttgaaataaaatggtgaaagcattgatatcaatcattgtgactttatctcaaaacaatattgacacacatagatgtttttcttcctttatggtaagattacagcctttattgtcttaaatctcttatactcttcaatattttcaaagaaaacattctagtctcagaaatagtccatctctttgcaaaacagggctggccaattatcaaggacccataaaaatcaaaacactttcaaaaattttaaaaataaaaataattttcacatgattgctttaggaattttgaagtatccattcttttcactatggagtgttgaatatagaagattttttaatgaacaggcttgccctttgatgccaaaggcaaaaaataataataataacatttgcacgtgtgatcacagagcagctgtgaggcatcccgggggagcgcacgcagtggggatgtgattgctccactcaactattttatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcgtgtaccatttggagacacatgaaggatacagtagacagcacggaaggcagcagcaacacacaggggtgtcctccctccccagagcccagtgtgcacacagaaccaaattcaatctcattcatcgtgagcttgcatggtaactgatccagccactcagtacctccattggataagagatttggccacagattcttctagagaaaatccaaatgtggagggtgcatttgtttctgcacccaaacaaataccttttgagatttcttataggcattcctctcgaagtctcattactctgatcagttattgatcggaggctaccctggctcagtcaccagctgctcactgtgtccttctgtggtctcaggagctgcagttgttgctgttgtatgaatagacgatagttaattagactggatgtgtctgtactggcagtgattttgcaacttcctctgtataagcgatacatttgtaaatcatgggaatgtatttgatggtaattgcctgtggtggttgtatcatgatttaattttattatgagcttttggctttatatatttttctgcctttttatgcattcattaaacagtttaacagaccaaggacagtgtactaa

SEQ ID NO: 322611 - DNA, 798 bp, Homo sapiens
  misc_feature (685)..(685): n is a, c, g, or t
  misc_feature (689)..(689): n is a, c, g, or t
  misc_feature (700)..(700): n is a, c, g, or t
  misc_feature (702)..(703): n is a, c, g, or t
  misc_feature (709)..(709): n is a, c, g, or t
  misc_feature (722)..(722): n is a, c, g, or t
  misc_feature (726)..(726): n is a, c, g, or t
  misc_feature (728)..(728): n is a, c, g, or t
  misc_feature (731)..(731): n is a, c, g, or t
  misc_feature (733)..(733): n is a, c, g, or t
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaattggcaggagcttgtagtcccagntacncgggaggctgngnngggagnactgcttgaaccngggngncanangttgcggtgggccgggatcgcgccactgcactccagcctgggcaacagagtgagactctgtctca

SEQ ID NO: 322612 - DNA, 714 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacccacacagcacgtgctgtgacgatggctgaacggaaagtgtacactgttcctgaatattgaaataaaacaataaacttttaatggta

SEQ ID NO: 322613 - DNA, 1112 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaagaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaaaaaaaactcctggggctgcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggg

SEQ ID NO: 322614 - DNA, 650 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctgggtaggtgacgaacgcacttccatcggcttcctcttccgtcccagtcctcacagccccgcaacttttgtgttctgctctgtttcggttgcttcctggcctccttttctctcctctcgagacctctctgcccacagctgggatcgggccgccttgtcttccactggggaaatgaaacgtggtcttcccttccggaaggtctggtctcttgcttctgtgccggggacccagccctgcaaggccagatcctcttctcccagagggttcccaggcgacgtgactggtctccctcccagggagggagcaacaccacgtccgag

SEQ ID NO: 322615 - DNA, 472 bp, Homo sapiens
atcttgaaaacagatgtgaaactgattatctgataaaaaatttataaagagacaaatgcattacaattattttgttgataaaacaatttatcttaagaaaagggtttgttgtgttttctttttccagaatagtgaaactaacagaggagaatctgaaaaaaagagaaacctgggtgaactttcacggacaacctcagaggacaacgaagtgttcggtaggtgacgcagatatcggcaacatggcgccacatggtgacagcgtgcacctgcactctcactcggggaagcctttgatttttttattgcatgggtgatccatggatctgtctgtactcattactaaaacatagaggctgggatcattgcttcatgtctgtaatcgcacacttcatggggtctatgcaagaggatcgcttgagcccaggagctcaagaccagcccgggcaacacaatgagacctcgtctctacaaa

SEQ ID NO: 322616 - DNA, 457 bp, Homo sapiens
acccccttcagcgtggttgctgccccgtggctcctgaaccactcaccagtccagtccggggcctgggcccttccccggggccctggtggcagctcccagtggctcaagcagcgtgcccagcaccgcgggtggaggttgagctccgtggtcttctcttgcagggggccgaaggccagagaccaggatttggctacggaggcagagcgtccgactataaatcggctcacaagggattcaagggagtcgatgcccagggcacgctttccaaaatttttaagctggtaaggtaccctctgctcagctccactgagcggggactaagggctcccagaatccccaactaagctgagtacaagggtggctgccgcctctggctcagccgcactgtaccctggacgtgctctgtcccagcaggcgtgcaggggctcaggtggcattgcccacccgcatttacgcg

SEQ ID NO: 322617 - DNA, 2092 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322618 - DNA, 1952 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaacgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322619 - DNA, 1771 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322620 - DNA, 1822 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322621 - DNA, 2168 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaaaaaacacttgccgccgtttaccacgtcgtgacttggccctgccgttaccactttcgccttgcggtcccctt

SEQ ID NO: 322622 - DNA, 2042 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaaccaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322623 - DNA, 1904 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322624 - DNA, 1296 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaattgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322625 - DNA, 4215 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaagaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaactctgctatggggtccagagtctaggagtggtttctgcagttgattgtcagtggagaacctgtggctgctggttcatcaaagcgctggtccctgagtgccattcagattgcagatgcagtattttacgtgatgtttagagtgtttggtggttgtgtaattttggagagaaagaagtttttcccaaaaaagtccctagtttattgggtgttctcacacaacctgtaagatgaagctgtttttctgcctgtgtgcagggctgattctggaattccagaaggccttgtgggagcgtaaaaggcttttgaataaagtgtggaacagagcgcctcattctgataacatgcaatcataaaaaccatagggcaacttggagttaaggagtttctagaatttgctttagtctccaactgcaattctttattgatcatgaaattgttgaagagaaacacaaatgtcagttttacctttcctgtgggcgtgaaagcacatcgaagtttcaggcaactgttaacatctctaccatctgtctgagttgagatttcaggttgtgacacttgccgtgacttatttgtaaatgacattttgtgtgtcttagatactaatggaattcatattctggctagttctttcagtgcatttgtagacatgttcttttcctttgtagcagtcctccctcaccctgaaatgttggtgttctaaccgatttctaatgctaatttcaactggaagcactttttcaagcccagctatcaaaccacaccagacatgtatggattcgggttgcccaataaagcgttgctattatgtaagcatccctcacgcatacagcatcaccagttttgaaagcttgaactattctgcttacttcaaggtacagaaaaaaaaaatgtacttaaactgtgcagaaaagatgaaatcactggataatatgtattataaaataagcttcatgtgagtgacactggtttaagttgaaataaaatggtgaaagcattgatatcaatcattgtgactttatctcaaaacaatattgacacacatagatgtttttcttcctttatggtaagattacagcctttattgtcttaaatctcttatactcttcaatattttcaaagaaaacattctagtctcagaaatagtccatctctttgcaaaacagggctggccaattatcaaggacccataaaaatcaaaacactttcaaaaattttaaaaataaaaataattttcacatgattgctttaggaattttgaagtatccattcttttcactatggagtgttgaatatagaagattttttaatgaacaggcttgccctttgatgccaaaggcaaaaaataataataataacatttgcacgtgtgatcacagagcagctgtgaggcatcccgggggagcgcacgcagtggggatgtgattgctccactcaactattttatcacaaagtgttgtaaacatgggagatgaaagcttaactctctctacacccagctacagacccgcaatggccctaaaaatctggggtattcattgggtgggctgccatggaggaatttttggttttgtttttatttttatttgttgttctgtttacaaatcaggagagcccctgtttttatatgctaggaaggtccttgggataggccgaagaggtgtgcaaacgagcagtggaaggcccgggccctgtctctcaggaccacggcggcctgccccacacacagttctgcttctccctatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcgtgtaccatttggagacacatgaaggatacagtagacagcacggaaggcagcagcaacacacaggggtgtcctccctccccagagcccagtgtgcacacagaaccaaattcaatctcattcatcgtgagcttgcatggtaactgatccagccactcagtacctccattggataagagatttggccacagattcttctagagaaaatccaaatgtggagggtgcatttgtttctgcacccaaacaaataccttttgagatttcttataggcattcctctcgaagtctcattactctgatcagttattgatcggaggctaccctggctcagtcaccagctgctcactgtgtccttctgtggtctcaggagctgcagttgttgctgttgtatgaatagacgatagttaattagactggatgtgtctgtactggcagtgattttgcaacttcctctgtataagcgatacatttgtaaatcatgggaatgtatttgatggtaattgcctgtggtggttgtatcatgatttaattttattatgagcttttggctttatatatttttctgcctttttatgcattcattaaacagtttaacagaccaaggacagtgtactaa

SEQ ID NO: 322626 - DNA, 1406 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacaccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggta

SEQ ID NO: 322627 - DNA, 1395 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggcggacctcgaacaaccccctgtgttcctgcacattaagcatgagcatgcaaacatgtttccaggtctgcgcaggcacacacctccacaccgctttgcacatagacacgtgtgagtgccatgcacacactttcacacccgggtgcacatgctctatgccccactttcatgtccacacaagcacggtccccagagtc

SEQ ID NO: 322628 - DNA, 1230 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaacaaaaaattggccgcgttttccaaacgtcgacctgggaacccttggctaccca

SEQ ID NO: 322629 - DNA, 840 bp, Homo sapiens
ccaggatttggctacggaggcagagcgtccgactataaatcggctcacaagggattcaagggagtcgatgcccaggggcacagagacacgggcatccttgactccatcgggcgcttctttggcggtgacaggggtgcgcccaagcggggctctggcaagaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaa

SEQ ID NO: 322630 - DNA, 279 bp, Homo sapiens
ggaggacaagccgcagggactgtggacttgtcctgaggtcaccgcgcctctgtgtttcaggactcacaccacccggcaagaactgctcactacggctccctgccccagaagtcacacggccggacccaagatgaaaaccccgtagtccacttcttcaagaacattgtaagtgacgatcgatgggaagaggtagcaactgtgagggggaggaggggtgctggccactgctgtcatccacacaggacgttcgtacgctcgggggtggcaccggggtcatca

SEQ ID NO: 322631 - DNA, 997 bp, Homo sapiens
gatccggtgggagggaacatctggaacattagacaggatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaaggtaggagccagctctgatccctgtggccagctgaggccaacacttctgctaacatctctgcatcactttatgcactcaagaaatctttacatattaggtaactttatgcaattaaaatgcttctcttcacaaaaattaaaatgcctttccatgtttccgcactacatttgcacactgaagcaaccacatttgctgttagaaaagtactcctactacctaatttctggttaaaccaaggcctgatgttttctgcttccatttgtagtgagggtactttgtatcctataagcgagggactataggggtttctttgttcaaatttttcccacatccctgagaggctgacatgtgttgctgtgaccacttaattgatcccagcactttgggaggccaaggtggatggatcacctgaggtcaggagttcgagaccagcctggcgaacatggtgaaaccctatctctactaatgatacaaaaatcagcctgttgtggtggcaggctcttgtagtcccagctacttgggaggctgaggcaggaaaattgcttgaacccaggaggcaaaggttgcaatgagccaatattgtgccactacactccagcctgggcaacagagtgagactccatctcaaaa

SEQ ID NO: 322632 - DNA, 629 bp, Homo sapiens
cacacacaaacacacacacatgtgcgtgcaatataccacaatataccatcatcctttctatttatgtggagactagttcaatcgatttttctgtcacctaagaatttacctaccccaggagcctgccttccacacatacattaataacaccaaccagtaatgtcaaaaggaaaaattacaaacccagaaaattaaagtcattctgcacttgcccttggtttaacaggcatttcactcttggcacctttcctgtcctatcattaataagcatcttattgatacagtttatactccaaattctccaggcttgtgaaagtttcctcaggattgcttgaaaatgaaagtcctggccaggtgcgcagtggctcatgcctgtaatcccagcactttgagaggccgaggcgggtggatcacccgaggtcaggagttcaagaccagcgtagccaacatggtgaaaccctgtctctactaaaagtacaaaaattagccaggtgtggtcgcaggcgcctgtagtcctagctactcaggaggctgaggcaggagaattgcttaaattcggaggcagaggttgcagtgagctgagatcgcgccactgcactccagcctgggcgacagaatgaggctgtctc

SEQ ID NO: 322633 - DNA, 177 bp, Homo sapiens
  misc_feature (59)..(59): n is a, c, g, or t
aaaaaaacaacatttaacaattcaataaaacaaaaaacaaagttgtggacaacaactgnagcgcttaacagggcaaacaaaacacgctgctcaccctcacgccctgctaagctcccggggcgacgaggctgctgcgttcacactaataaaatccactggtgcatctgtaaaaaatgg

SEQ ID NO: 322634 - DNA, 1627 bp, Homo sapiens
ctactgtgagggctgttgaatttttctccaaagctcagatgcccagtattcctagtcttcgaaagagagagaggaagattgagagagagagagagagagagagagagaagaagttttcttaatcagagatttctctttactttcaactaattgcagatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagaaactgttcgaggtggaggaggtgaactgcatctgcgtggactggaagaagggctcccaagccacctacacacaggctgccaacaacgtgcgagtggtgggcgcccaggtggcccagatgctcgacatcctcttgacagagtatagctaccccccttccaaagttcacctcattggccacagcctgggagcccacgtggctggagaggcaggaagcaagactccaggcctgagcaggattacagggttggatcctgtagaagcaagtttcgagagtactcctgaagaggtgcgacttgatccctctgatgctgactttgttgatgtgattcacacggatgcagctcccctgatcccattcttgggttttggaacgaaccaacagatgggtcatcttgacttcttccccaatggaggagagagcatgccgggatgcaagaagaatgccctgtctcagatcgtggatctagatggcatctgggcgggaacccgggactttgtggcttgcaatcacctaagaagctacaagtattacttggaaagcatcctcaatcccgatgggtttgctgcatatccctgcacttcctacaagtcctttgagtctgacaagtgcttcccgtgtccagatcaaggatgcccacagatgggtcactatgctgataaatttgctggcaggacaagtgaagagcagcagaaattcttcttgaacacaggagaggctagcaatttcgctcgctggagatatggggtttccatcacactgtctggaagaacagccactggtcagatcaaagttgctttgtttggaaataagggaaacactcaccagtacagcatcttcagggggattctcaaaccaggctcaacccattcctatgagtttgatgcaaagctggatgttggaacaattgagaaagtcaagtttctttggaataacaatgtgataaatccaaccctccccaaagtgggtgccaccaagatcactgtgcaaaagggagaagagaagacagtgtacaacttctgtagcgaagacacagtgcgggaagacacgctgctcaccctcacgccctgctaagctcccggggcgacgaggctgctgcgttcacactaataaaatccactggtgcatctgtaaaaaatgg

SEQ ID NO: 322635 - DNA, 1919 bp, Homo sapiens
gatccggtgggagggaacatctggaacattagacaggatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagcctggggcatcgccaagagcctgaaaggaccccttacagtcaaatccacaaggtcatttagacactggccaccggagattgcacctaagacttttccttttcaaaacaggactcttttcatgatgcaattgtttttcccttactaaccaaccttactgaatttggttgaaggaaaccagagagtagccagcttccaattaatctgcaagctggagggggaatcagtttgcctttctcatagcattcaccctgaaggataactcctaattaccaacaggattccctaacagagtctagtttatctcatgccctagctaggagaagagagaagtggccatttctgagccctggctggataaggtttcccctgctcccattatctccccaaccccactatctccccaacaccagaaactgttcgaggtggaggaggtgaactgcatctgcgtggactggaagaagggctcccaagccacctacacacaggctgccaacaacgtgcgagtggtgggcgcccaggtggcccagatgctcgacatcctcttgacagagtatagctaccccccttccaaagttcacctcattggccacagcctgggagcccacgtggctggagaggcaggaagcaagactccaggcctgagcaggattacagggttggatcctgtagaagcaagtttcgagagtactcctgaagaggtgcgacttgatccctctgatgctgactttgttgatgtgattcacacggatgcagctcccctgatcccattcttgggttttggaacgaaccaacagatgggtcatcttgacttcttccccaatggaggagagagcatgccgggatgcaagaagaatgccctgtctcagatcgtggatctagatggcatctgggcgggaacccgggactttgtggcttgcaatcacctaagaagctacaagtattacttggaaagcatcctcaatcccgatgggtttgctgcatatccctgcacttcctacaagtcctttgagtctgacaagtgcttcccgtgtccagatcaaggatgcccacagatgggtcactatgctgataaatttgctggcaggacaagtgaagagcagcagaaattcttcttgaacacaggagaggctagcaatttcgctcgctggagatatggggtttccatcacactgtctggaagaacagccactggtcagatcaaagttgctttgtttggaaataagggaaacactcaccagtacagcatcttcagggggattctcaaaccaggctcaacccattcctatgagtttgatgcaaagctggatgttggaacaattgagaaagtcaagtttctttggaataacaatgtgataaatccaaccctccccaaagtgggtgccaccaagatcactgtgcaaaagggagaagagaagacagtgtacaacttctgtagcgaagacacagtgcgggaagacacgctgctcaccctcacgccctgctaagctcccggggcgacgaggctgctgcgttcacactaataaaatccactggtgcatctgtaaaaaatgg

SEQ ID NO: 322636 - DNA, 1508 bp, Homo sapiens
gatccggtgggagggaacatctggaacattagacaggatgctgatcttctggacaatcacacttttcctgctgggagcagccaaaggaaaagaagtttgctatgaggacctcgggtgcttttctgacactgagccctggggcgggacagcaatcaggcccctgaaaattctcccctggagccctgagaagatcggcacccgcttcctgctgtacaccaatgaaaacccaaacaactttcaaattctcctcctctctgatccatcaacaattgaggcatcaaattttcaaatggacagaaagacccggttcatcatccatggcttcatagacaaaggagatgagagctgggtgacagacatgtgcaagaaactgttcgaggtggaggaggtgaactgcatctgcgtggactggaagaagggctcccaagccacctacacacaggctgccaacaacgtgcgagtggtgggcgcccaggtggcccagatgctcgacatcctcttgacagagtatagctaccccccttccaaagttcacctcattggccacagcctgggagcccacgtggctggagaggcaggaagcaagactccaggcctgagcaggattacagggttggatcctgtagaagcaagtttcgagagtactcctgaagaggtgcgacttgatccctctgatgctgactttgttgatgtgattcacacggatgcagctcccctgatcccattcttgggttttggaacgaaccaacagatgggtcatcttgacttcttccccaatggaggagagagcatgccgggatgcaagaagaatgccctgtctcagatcgtggatctagatggcatctgggcgggaacccgggactttgtggcttgcaatcacctaagaagctacaagtattacttggaaagcatcctcaatcccgatgggtttgctgcatatccctgcacttcctacaagtcctttgagtctgacaagtgcttcccgtgtccagatcaaggatgcccacagatgggtcactatgctgataaatttgctggcaggacaagtgaagagcagcagaaattcttcttgaacacaggagaggctagcaatttcgctcgctggagatatggggtttccatcacactgtctggaagaacagccactggtcagatcaaagttgctttgtttggaaataagggaaacactcaccagtacagcatcttcagggggattctcaaaccaggctcaacccattcctatgagtttgatgcaaagctggatgttggaacaattgagaaagtcaagtttctttggaataacaatgtgataaatccaaccctccccaaagtgggtgccaccaagatcactgtgcaaaagggagaagagaagacagtgtacaacttctgtagcgaagacacagtgcgggaagacacgctgctcaccctcacgccctgctaagctcccggggcgacgaggctgctgcgttcacactaataaaatccactggtgcatctgtaaaaaatgg

SEQ ID NO: 322637 - DNA, 2845 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagcagggcacctagggaaagatgtgaccccggaaagtactcagtttccctgccctggagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtgaggaccttgaagaaactgcatggttggatcagtctgatgaagcacttgaggcttcctgagcccaggcagatgtgaactcctggcaaggggtgggcaggtccagtttgggaagtcggggtggagcccagggctggccctggaatgcagtcctcagagcggctgtgctcataggtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322638 - DNA, 3035 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggtgagagcagctcgagcgggtgagagcagctggtgctgtggtgacccgttcccagagcgcccttggtttgcctttctcttccccaaatcccattgccagtggctgagacacgaaaggagcacttgggacaccagctccaacgccctgtcattatggtcacattgccttgtcctccctgggcctgctgtgaacgggatccaggtggggaaagaggtcaagacagggagcgatgctgagttcttggttccctccttgggccccacttcagctgtccttttccagagagtaggacctgctgggaaggagatgagcctggggccattaaggaaccttccttgtcccctgggaagtagcagctgagagatagcgagtgtctggagcggaggcctctctgaatgggcaggggtttgtccttgcaggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322639 - DNA, 1560 bp, Homo sapiens
cggacgcgtgggtcgacccacgcgtccgcgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322640 - DNA, 820 bp, Homo sapiens
ggggctttgagacgtgtccatcactcctctagaccagtcaccctttctctttagttctggtcttagggaagccatactgaagagctgccctcggtcgtgagccctaatgagcccatgtctcttctgagagtggattacagtctttgtcctgtgcaacccccctccctttctgtcccccttaggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggtgagagcagctcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322641 - DNA, 747 bp, Homo sapiens
ggggctttgagacgtgtccatcactcctctagaccagtcaccctttctctttagttctggtcttagggaagccatactgaagagctgccctcggtcgtgagccctaatgagcccatgtctcttctgagagtggattacagtctttgtcctgtgcaacccccctccctttctgtcccccttaggcagaggtgcagcctcagtgtggaagagccgtgggattctcttcaggcactgtgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322642 - DNA, 1494 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatggtgaaaaaaactttatccccttctttctttctttctttttaaatttattttagagacagagtcttgctctgtcacccaggctggagtgcagtggcttgatcatagctcgctgtaacctcaaattcctggactcaagagaccctctagtctcggcctcctgagtagttgggactacaggcatgcattcttttgtttttttttaaatgacattactaaggttgttttctaattacattacagaagtaatgaatgttcattgtataacattgtagaaatgtaggtaagtataaaataaaaagtaatcatttgtaataccgccaccttaagaaaaccagtttatattttgccctattttttaagtcttccgtatataattttttcatctaatttggtgttatatcatgtatgcattttttatcatcttttttattttttttgaggcagggtctcactttgttgtccaggctgcagtgcaatggtgtgatcatagctcactgcagccttgacctcctgggctcaagtgatcctcccgcctcagccccacaaatagctgggactagaggcatgcaccaccacacccagctattgtttttattttttgtagagacggggtctcactgtgttgcccaggctgatttcaaactcctggcctcaagcgatcctactgccttgggctcccaaagtgctgggattgcaggtgtgagccaccatggccagccccatcatcattttttaactaacattattatcatgagtcttttctcatgtcttcagttttatttgaaaacataat

SEQ ID NO: 322643 - DNA, 466 bp, Homo sapiens
tgctgcccctcctgtgtgggttgtcattgtagttgtcctctttagccactagatggtgaccatctggctttaagatggcacttccggtctcttcctcttaggtaaatatagtagatgacataggattcattgactcctttaattcctccttgaactgcctcatgttttatttcaactgatgtctcctttttctcttccttcctcctcctgctgcttggagattagcagggcacctagggaaagatgtgaccccggaaagtactcagtttccctgccctgggtaagccttgcctgggagtccatgtgggaagcccagagtgccaggccctcccctttagctgcttatcctcagggaggggtgtggtctggttagggtctgagaggaggcaggtggcagagcagaaagcacatgggctttaggactgtaaagacccggctttatctgtccaaatgcacattctgctat

SEQ ID NO: 322644 - DNA, 2526 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgaggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322645 - DNA, 2430 bp, Homo sapiens
cggctgggttgggaattcggacgagcgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322646 - DNA, 2487 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322647 - DNA, 3085 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggtgagagcagctcgagcgggtgagagcagctggtgctgtggtgacccgttcccagagcgcccttggtttgcctttctcttccccaaatcccattgccagtggctgagacacgaaaggagcacttgggacaccagctccaacgccctgtcattatggtcacattgccttgtcctccctgggcctgctgtgaacgggatccaggtggggaaagaggtcaagacagggagcgatgctgagttcttggttccctccttgggccccacttcagctgtccttttccagagagtaggacctgctgggaaggagatgagcctggggccattaaggaaccttccttgtcccctgggaagtagcagctgagagatagcgagtgtctggagcggaggcctctctgaatgggcaggggtttgtccttgcaggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggttttttttacttggtttgttcagacaatggaaatttgcccattctgtcaaaaaaatct

SEQ ID NO: 322648 - DNA, 2970 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggttttttttaaaaaaaaaaaaaaaaaaaaaaaaaaaaatttttggggcgccgggcccaaaaaagtttaaaaccctggtggggggcggggccccggggtacggtagcccctgtggggccaacgcggtgtcccaagagagaaacccgggggcaggacctgagggcgggggtttccccaccattaaaaaacgcccgggggggaacccgggcggtcctggaacaaaccacagggggacgtcccggagggcccatcacggggctctacccacggagcccccaagcgagagccgataccaaatgacgcggcgccgggggaaaacacagcaggaaaacgagacaaaacacacacaacaacacgaaacatg

SEQ ID NO: 322649 - DNA, 2717 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttttttttttttttttttttttttttttttttttggggggggggggggggggaaaaaaataaaggggggggaaggggggggggaaataaaaaaaaggggggggg

SEQ ID NO: 322650 - DNA, 2543 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggttttttttacttggtttgttcagacaatggaaatttgcccattctgtcaaaaaaatct

SEQ ID NO: 322651 - DNA, 1882 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322652 - DNA, 1596 bp, Homo sapiens
  misc_feature (1556)..(1556): n is a, c, g, or t
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccccggtagccatctcctgaggttgctgccacanttggtcagtctacagctcgtacatctcgtgtcaagtacat

SEQ ID NO: 322653 - DNA, 944 bp, Homo sapiens
aagacacccccctagttcattgggcattccgtagactcaaacacattttgggaagcacctcccctgccaagaagagagctatgccgtctcccgaggtgctcccttgctaacatgtgtgacattggccccagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322654 - DNA, 870 bp, Homo sapiens
ggggctttgagacgtgtccatcactcctctagaccagtcaccctttctctttagttctggtcttagggaagccatactgaagagctgccctcggtcgtgagccctaatgagcccatgtctcttctgagagtggattacagtctttgtcctgtgcaacccccctccctttctgtcccccttaggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggtgagagcagctcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggttttttttacttggtttgttcagacaatggaaatttgcccattctgtcaaaaaaatct

SEQ ID NO: 322655 - DNA, 2616 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322656 - DNA, 1621 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaaggtgcagacctgcctggaaccaggcggccggggtccttctggggagaggagtgttgcaggggacctgaggagcttgggggatcggggaagtgtccgcagggaggggaaagtggcctcctggctggggagctctcctcggagccggggagagctgctccctggcaggagaccttcctcgcccagttcgcatgggcagatgctaaccccaaaggtccagcctggggttagggcacaggccaagcaaaactcatggccattttgttccctgggaaatctcctggaaggaattaaagcggcagtttgggtctcccattctgatgtcattgtaagtgtccgagtgagaagctagtagcggtctacaatatctcccttccggttggttttccagtggtgcttttcctgctgtttgattcagcagctctctttcaggatgtgaggttgccacgtcgccagcaggggctgcctggccctttctgtgtgtgtgtgggggcgggggggggaccctctggctagtctgccaggtttacaaagaaaatgagtatttttcggaatgccagagtgccatgtgtccaagtgtacacttgggcttggagcgttccaggcttgtttggtggtggtgatggtgacgatgatgatgatgatgatagccagcacatacttccaggcactattttaagcagtttgcatttattaacgcatttgccctaatcttcataatatcttgtcaggtagatgctgttattagtcccactgtattgggggtggggggagaaagagttgtgcattatatctggtatatctgttgtttaaaagaccttcgattcgatctaaagagacacttagagactcttggggacctcagatttccacccctccacagcattctgcctacacagttcccctcatttttcctagttactcggaagagcgctggacttgaaatcaaaataattgcgttatgtctttggttatgtcgcttcatcatagcactttctaaaactatttgacaaacatgtattgcatacctactgcattccagttcttgtacaagtaattaaatgctcgactaacgtc

SEQ ID NO: 322657 - DNA, 2666 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggttttttttacttggtttgttcagacaatggaaatttgcccattctgtcaaaaaaatct

SEQ ID NO: 322658 - DNA, 2790 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtgaggaccttgaagaaactgcatggttggatcagtctgatgaagcacttgaggcttcctgagcccaggcagatgtgaactcctggcaaggggtgggcaggtccagtttgggaagtcggggtggagcccagggctggccctggaatgcagtcctcagagcggctgtgctcataggtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322659 - DNA, 2586 bp, Homo sapiens
atgctttgtaacttaacgtgttaaaagcaggtcgcgatctcggtgtgcggtctagtctgagacgaggtacgcgcgtgactgtgacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322660 - DNA, 2685 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggtgagagcagctcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggttttttttacttggtttgttcagacaatggaaatttgcccattctgtcaaaaaaatct

SEQ ID NO: 322661 - DNA, 2716 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagttccatgtggctggggaagcctcacaatcatggtggaaggcaaagaggagcaagtcacatcttacatggatggcagcaggcaaagagagaacttctgcagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322662 - DNA, 2810 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagaggggcgttgtgttagtccgttttcacactgctgataaagacgtacccgagactgggcaatttacaaaagaaagaggtttacttggacttacagttccatgtggctggggaagcctcacaatcatggtggaaggcaaagaggagcaagtcacatcttacatggatggcagcaggcaaagagagaacttctgcagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322663 - DNA, 2635 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggtgagagcagctcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322664 - DNA, 2300 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatgatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322665 - DNA, 2333 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggagcagcccctggatgcccagcagggcccccccgaacctgcacaagagtctctctcaggcagtgaccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322666 - DNA, 1843 bp, Homo sapiens
cgcccgggggcgggccttcgccgggggtaggactccggccttggtggcgggtggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggccccaggggcctccacaggccgctgcataacagcgatacagtacttaagtgtctgtgtagacaaccaaagaataaatgattcatggtttttttt

SEQ ID NO: 322667 - DNA, 891 bp, Homo sapiens
tgggttcgctaaaccgaggaaatacgcacaactagttgtctactctacatctggatgtgccgcacatgccaggcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322668 - DNA, 826 bp, Homo sapiens
cggacgcgtgggtcgacccacgcgtccgcgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggctggatctggctgagggctcaggacacaggcccagccacccccaggggcctccacaggccgctgcataacagcgatacagtacttaagtgtctgtgtagacaaccaaagaataaatgattcatggtttttttt

SEQ ID NO: 322669 - DNA, 314 bp, Homo sapiens
tgggtatggaaaagattctgattcaaggccaaaaagagggtgagcaatgtgggctttggggagcttacaaccctgctgtgtgtcaagattagtatcaatacagccgatcatagacccagcctaacaggcttaacttatttgagatttagattcctaccacgtaatctgaataatgccttcatagaagtgatcgtaatatacaatccaacaggatcaaagaactaaatcattctgagaaactctgctgaaacctgagaaaaaggaccagggagaagctgggagatagatggatgagaaagggaagacaaggaaaa

SEQ ID NO: 322670 - DNA, 2767 bp, Homo sapiens
agagtcatccagctggagccctgagtggctgagctcaggccttcgcagcattcttgggtgggagcagccacgggtcagccacaagggccacagccatgaatggcacagaaggccctaacttctacgtgcccttctccaatgcgacgggtgtggtacgcagccccttcgagtacccacagtactacctggctgagccatggcagttctccatgctggccgcctacatgtttctgctgatcgtgctgggcttccccatcaacttcctcacgctctacgtcaccgtccagcacaagaagctgcgcacgcctctcaactacatcctgctcaacctagccgtggctgacctcttcatggtcctaggtggcttcaccagcaccctctacacctctctgcatggatacttcgtcttcgggcccacaggatgcaatttggagggcttctttgccaccctgggcggtgaaattgccctgtggtccttggtggtcctggccatcgagcggtacgtggtggtgtgtaagcccatgagcaacttccgcttcggggagaaccatgccatcatgggcgttgccttcacctgggtcatggcgctggcctgcgccgcacccccactcgccggctggtccaggtacatccccgagggcctgcagtgctcgtgtggaatcgactactacacgctcaagccggaggtcaacaacgagtcttttgtcatctacatgttcgtggtccacttcaccatccccatgattatcatctttttctgctatgggcagctcgtcttcaccgtcaaggaggccgctgcccagcagcaggagtcagccaccacacagaaggcagagaaggaggtcacccgcatggtcatcatcatggtcatcgctttcctgatctgctgggtgccctacgccagcgtggcattctacatcttcacccaccagggctccaacttcggtcccatcttcatgaccatcccagcgttctttgccaagagcgccgccatctacaaccctgtcatctatatcatgatgaacaagcagttccggaactgcatgctcaccaccatctgctgcggcaagaacccactgggtgacgatgaggcctctgctaccgtgtccaagacggagacgagccaggtggccccggcctaagacctgcctaggactctgtggccgactataggcgtctcccatcccctacaccttcccccagccacagccatcccaccaggagcagcgcctgtgcagaatgaacgaagtcacataggctccttaatttttttttttttttaagaaataattaatgaggctcctcactcacctgggacagcctgagaagggacatccaccaagacctactgatctggagtcccacgttccccaaggccagcgggatgtgtgcccctcctcctcccaactcatctttcaggaacacgaggattcttgctttctggaaaagtgtcccagcttagggataagtgtctagcacagaatggggcacacagtaggtgcttaataaatgctggatggatgcaggaaggaatggaggaatgaatgggaagggagaacatatctatcctctcagaccctcgcagcagcagcaactcatacttggctaatgatatggagcagttgtttttccctccctgggcctcactttcttctcctataaaatggaaatcccagatccctggtcctgccgacacgcagctactgagaagaccaaaagaggtgtgtgtgtgtctatgtgtgtgtttcagcactttgtaaatagcaagaagctgtacagattctagttaatgttgtgaataacatcaattaatgtaactagttaattactatgattatcacctcctgatagtgaacattttgagattgggcattcagatgatggggtttcacccaaccttggggcaggtttttaaaaattagctaggcatcaaggccagaccagggctgggggttgggctgtaggcagggacagtcacaggaatgcagaatgcagtcatcagacctgaaaaaacaacactgggggagggggacggtgaaggccaagttcccaatgagggtgagattgggcctggggtctcacccctagtgtggggccccaggtcccgtgcctccccttcccaatgtggcctatggagagacaggcctttctctcagcctctggaagccacctgctcttttgctctagcacctgggtcccagcatctagagcatggagcctctagaagccatgctcacccgcccacatttaattaacagctgagtccctgatgtcatccttatctcgaagagcttagaaacaaagagtgggaaattccactgggcctaccttccttggggatgttcatgggccccagtttccagtttcccttgccagacaagcccatcttcagcagttgctagtccattctccattctggagaatctgctccaaaaagctggccacatctctgaggtgtcagaattaagctgcctcagtaactgctcccccttctccatataagcaaagccagaagctctagctttacccagctctgcctggagactaaggcaaattgggccattaaaagctcagctcctatgttggtattaacggtggtgggttttgttgctttcacactctatccacaggatagattgaaactgccagcttccacctgatccctgaccctgggatggctggattgagcaatgagcagagccaagcagcacagagtcccctggggctagaggtggaggaggcagtcctgggaatgggaaaaacccca

SEQ ID NO: 322671 - DNA, 659 bp, Homo sapiens
agagtcatccagctggagccctgagtggctgagctcaggccttcgcagcattcttgggtgggagcagccacgggtcagccacaagggccacagccatgaatggcacagaaggccctaacttctacgtgcccttctccaatgcgacgggtgtggtacgcagccccttcgagtacccacagtactacctggctgagccatggcagttctccatgctggccgcctacatgtttctgctgatcgtgctgggcttccccatcaacttcctcacgctctacgtcaccgtccagcacaagaagctgcgcacgcctctcaactacatcctgctcaacctagccgtggctgacctcttcatggtcctaggtggcttcaccagcaccctctacacctctctgcatggatacttcgtcttcgggcccacaggatgcaatttggagggcttctttgccaccctgggcggtgaaattgccctgtggtccttggtggtcctggccatcgagcggtacgtggtggtgtgtaagcccatgagcaacttccgcttcggggagaaccatgccatcatgggcgttgccttcacctgggtcatggcgctggcctgcgccgcacccccactcgccggctggtccaggtaatccgaggactgagtctgtgtgaatgatagc

SEQ ID NO: 322672 - DNA, 2079 bp, Homo sapiens
  misc_feature (34)..(34): n is a, c, g, or t
  misc_feature (56)..(56): n is a, c, g, or t
  misc_feature (62)..(62): n is a, c, g, or t
  misc_feature (71)..(71): n is a, c, g, or t
  misc_feature (84)..(84): n is a, c, g, or t
  misc_feature (94)..(94): n is a, c, g, or t
aaccgggctattttggaccccccactcacgggcncccgattttcaacaattggccnctccanccatgatanactttctccatgnagtctcttcncctcaaggagccgctgcccagcagcaggagtcagccaccacacagaaggcagagaaggaggtcacccgcatggtcatcatcatggtcatcgctttcctgatctgctgggtgccctacgccagcgtggcattctacatcttcacccaccagggctccaacttcggtcccatcttcatgaccatcccagcgttctttgccaagagcgccgccatctacaaccctgtcatctatatcatgatgaacaagcagttccggaactgcatgctcaccaccatctgctgcggcaagaacccactgggtgacgatgaggcctctgctaccgtgtccaagacggagacgagccaggtggccccggcctaagacctgcctaggactctgtggccgactataggcgtctcccatcccctacaccttcccccagccacagccatcccaccaggagcagcgcctgtgcagaatgaacgaagtcacataggctccttaatttttttttttttttaagaaataattaatgaggctcctcactcacctgggacagcctgagaagggacatccaccaagacctactgatctggagtcccacgttccccaaggccagcgggatgtgtgcccctcctcctcccaactcatctttcaggaacacgaggattcttgctttctggaaaagtgtcccagcttagggataagtgtctagcacagaatggggcacacagtaggtgcttaataaatgctggatggatgcaggaaggaatggaggaatgaatgggaagggagaacatatctatcctctcagaccctcgcagcagcagcaactcatacttggctaatgatatggagcagttgtttttccctccctgggcctcactttcttctcctataaaatggaaatcccagatccctggtcctgccgacacgcagctactgagaagaccaaaagaggtgtgtgtgtgtctatgtgtgtgtttcagcactttgtaaatagcaagaagctgtacagattctagttaatgttgtgaataacatcaattaatgtaactagttaattactatgattatcacctcctgatagtgaacattttgagattgggcattcagatgatggggtttcacccaaccttggggcaggtttttaaaaattagctaggcatcaaggccagaccagggctgggggttgggctgtaggcagggacagtcacaggaatgcagaatgcagtcatcagacctgaaaaaacaacactgggggagggggacggtgaaggccaagttcccaatgagggtgagattgggcctggggtctcacccctagtgtggggccccaggtcccgtgcctccccttcccaatgtggcctatggagagacaggcctttctctcagcctctggaagccacctgctcttttgctctagcacctgggtcccagcatctagagcatggagcctctagaagccatgctcacccgcccacatttaattaacagctgagtccctgatgtcatccttatctcgaagagcttagaaacaaagagtgggaaattccactgggcctaccttccttggggatgttcatgggccccagtttccagtttcccttgccagacaagcccatcttcagcagttgctagtccattctccattctggagaatctgctccaaaaagctggccacatctctgaggtgtcagaattaagctgcctcagtaactgctcccccttctccatataagcaaagccagaagctctagctttacccagctctgcctggagactaaggcaaattgggccattaaaagctcagctcctatgttggtattaacggtggtgggttttgttgctttcacactctatccacaggatagattgaaactgccagcttccacctgatccctgaccctgggatggctggattgagcaatgagcagagccaagcagcacagagtcccctggggctagaggtggaggaggcagtcctgggaatgggaaaaacccca

SEQ ID NO: 322673 - DNA, 3164 bp, Homo sapiens
  misc_feature (2030)..(2030): n is a, c, g, or t
caacaggaagcggcccctcccggcttcggagccgccgccactcgtctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctangagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaa

SEQ ID NO: 322674 - DNA, 3653 bp, Homo sapiens
  misc_feature (2519)..(2519): n is a, c, g, or t
ggggtgcgcttccggggaaacgcagctgcggtcgctcgggaaccacgcctggcaggttcagtcgcaacatcctcccgccgtttgttgaggcagtttggtggagggaagtggaacctacgcggacagaggctgtttctctgtcaggaggcaagcacgagtgctgaggaaaactttgcccttgccatgagacacttctcagacacagcgtggcactgaggccatcaaggggcgccggcacagggacgcttggagggagatggggcaggatccactcgtctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctangagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaa

SEQ ID NO: 322675 - DNA, 3442 bp, Homo sapiens
  misc_feature (2308)..(2308): n is a, c, g, or t
ggggtgcgcttccggggaaacgcagctgcggtcgctcgggaaccacgcctggcaggtccactcgtctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctangagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaa

SEQ ID NO: 322676 - DNA, 3967 bp, Homo sapiens
  misc_feature (2833)..(2833): n is a, c, g, or t
caacaggaagcggcccctcccggcttcggagccgccgccactcgtctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggtcagggaccctcttgctgaatttcccctccccctgcctgactgtggcctggctcctgcctctcccttccaaacttgtcctcactgcaaggaactccacacttttctgtttttttggtctcagcagcaaaggagaaggaacctgtcccctcagggattaagcaagcacagccctagttgatcacccagcatgaaaagtcctggaatctctcagagatgaacctgtgtatgggagttttgcttaagtggtacttcaagaaggtgcctctgtttactttggttttgcactgccatgcgaccaggtggtgcaggtctcccaaatgccacccccctccaagcttccctctttgctctaagtcctcaggcctcctgggcctgggacagatggttgtttgtgtcatcaggactcgtggggttctatgcgtggagcactcaccgcagcctaagctgggatcccagctcagaggtcaggccatgttgggatgtttagggaaggtgatgcattatcaggagacatatctactgtcccctgccctgtacccccaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctangagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaa

SEQ ID NO: 322677 - DNA, 3457 bp, Homo sapiens
  misc_feature (2288)..(2288): n is a, c, g, or t
caacaggaagcggcccctcccggcttcggagccgccgccactcgtctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctangagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaaggcgctggaggcagtagaacgtctcagttcttcttcctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaa

SEQ ID NO: 322678 - DNA, 1729 bp, Homo sapiens
  misc_feature (595)..(595): n is a, c, g, or t
taggctggttacggcccggggtgtatgggatcggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctangagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaa

SEQ ID NO: 322679 - DNA, 3328 bp, Homo sapiens
  misc_feature (2288)..(2288): n is a, c, g, or t
caacaggaagcggcccctcccggcttcggagccgccgccactcgtctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctangagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccaggttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaa

SEQ ID NO: 322680 - DNA, 1384 bp, Homo sapiens
  misc_feature (305)..(305): n is a, c, g, or t
agccccttgtgttcatctgtacgcatcccctcccagctggccctgcccctctaccctccctgcctgagcacttacctccttagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctangagcagcacccaggagatggacatttctactgcctccagcacctgccccagacagaccacaaagcggaaggcagcgatagaggccctgagagtccgcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaa

SEQ ID NO: 322681 - DNA, 613 bp, Homo sapiens
gcagccgcctactactactaaattcccggccggtcgacagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaa

SEQ ID NO: 322682 - DNA, 1620 bp, Homo sapiens
caacaggaagcggcccctcccggcttcggagccgccgccactcgtctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccggtgagcaggccttcctcccaaggg

SEQ ID NO: 322683 - DNA, 505 bp, Homo sapiens
tgctcagcagctggggttgtgggtatcagatctgtccctgtgttgcatgcaaaggcagctctgtcctctccacatctaagaaatccccgcacaccctgattccaaggcctaaggaaggcaggctaagaattcctaccccagggcttggagatccctggacagggaggctgaactggaggctcccctggtgtcccatgtgccctctgtgcccaagactaatgtttttcacttccaaatttggcaaatttcacttggagtggactggatagcagctgtctctggagcagatgctggcaggggaatgggctgggaggagcagagccaatcactggtgaatcccgagctccctggggacaccagcctgctctcttcgcctccccttcctttttatttcttctgttctccagcctcttccccttctttttccacctctccagccactcgtctctgcccagctgctgccctccccaggaggcctccatggcttcacctacctccaccaacc

SEQ ID NO: 322684 - DNA, 377 bp, Homo sapiens
aaaccccctcgggcacccttcaggtggcgtgggagggggcgacaaagcgaggctttgtctccggagattcctgggagagcgcgcccgggcgcacagggggcggggcggggtaggggtcgatcagggaggggggaacctgggaggggcgcacccggctgcggtcgacccccagccctacccacggccccctggagtagggcacattcacagaggaagtgttttgaccacagtgcgtcagaaatagacccaggcctccgttccccagtcagtcgcaacatcctcccgccgtttgttgaggcagtttggtggagggaagtggaacctacgcggacagaggctgtttctctgtcaggaggcaagcacgagtgctgaggaaa

SEQ ID NO: 322685 - DNA, 3422 bp, Homo sapiens
  misc_feature (2288)..(2288): n is a, c, g, or t
caacaggaagcggcccctcccggcttcggagccgccgccactcgtctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctangagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaa

SEQ ID NO: 322686 - DNA, 558 bp, Homo sapiens
tcctcccatgccccaacacatacattcagtctttaccagacttgcagggcctccgtcaccaccatgctctttgttgcctgactggggcaggcgctggaggcagtagaacgtctcagttcttcttcctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacgtaaggggaaggggatggtgacagtggcccatg

SEQ ID NO: 322687 - DNA, 3841 bp, Homo sapiens
  misc_feature (2707)..(2707): n is a, c, g, or t
caacaggaagcggcccctcccggcttcggagccgccgccactcgtctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacagcaaaggagaaggaacctgtcccctcagggattaagcaagcacagccctagttgatcacccagcatgaaaagtcctggaatctctcagagatgaacctgtgtatgggagttttgcttaagtggtacttcaagaaggtgcctctgtttactttggttttgcactgccatgcgaccaggtggtgcaggtctcccaaatgccacccccctccaagcttccctctttgctctaagtcctcaggcctcctgggcctgggacagatggttgtttgtgtcatcaggactcgtggggttctatgcgtggagcactcaccgcagcctaagctgggatcccagctcagaggtcaggccatgttgggatgtttagggaaggtgatgcattatcaggagacatatctactgtcccctgccctgtacccccaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctangagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaa

SEQ ID NO: 322688 - DNA, 3703 bp, Homo sapiens
  misc_feature (2288)..(2288): n is a, c, g, or t
caacaggaagcggcccctcccggcttcggagccgccgccactcgtctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctangagcagcacccaggagatggacatttctactgcctccagcacctgccccagacagaccacaaagcggaaggcagcgatagaggccctgagagtccgaaagactgaaggcgtgtatgtatattggggcatgggaagaggaagagggtctcgtcaaaccagcgctttgctgggggtaactgaatgtcgtcttctactagcatgtaagctctgtgaaggcagggatgcctgtctgcttacacttcttgttctctcaagtatctaaaacacagccagacactgtttgtaaatggttttaagtgaatgaatgccaaggctcacctttgctccgaaggggtggcctcaccccccgacctcactccacatggtggcttttccaggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaa

SEQ ID NO: 322689 - DNA, 3508 bp, Homo sapiens
  misc_feature (2288)..(2288): n is a, c, g, or t
caacaggaagcggcccctcccggcttcggagccgccgccactcgtctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctangagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagacttgcagggcctccgtcaccaccatgctctttgttgcctgactggggcaggcgctggaggcagtagaacgtctcagttcttcttcctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaa

SEQ ID NO: 322690 - DNA, 1439 bp, Homo sapiens
  misc_feature (305)..(305): n is a, c, g, or t
agccccttgtgttcatctgtacgcatcccctcccagctggccctgcccctctaccctccctgcctgagcacttacctccttagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctangagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgagggtgggccgtctgctttcgttcccacaaagaaagcacctcaccccagcacagtgccacccctgttcatctgggctgcctggcagagagccttgctgtttacaattaaaatgtttctgccacaaaaaaaaaaaa

SEQ ID NO: 322691 - DNA, 3513 bp, Homo sapiens
  misc_feature (2288)..(2288): n is a, c, g, or t
caacaggaagcggcccctcccggcttcggagccgccgccactcgtctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaacggccatttcttccaccggagctgcttccgctgccatacctgtgaggccacactgtggccaggtggctangagcagcacccaggagatggacatttctactgcctccagcacctgccccagacagaccacaaagcggaaggcagcgatagaggccctgagagtccggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcatgttcccccgagaaaccaggcaaaaaaggaaacactatgggggttaggggaccaaaggtcctgggcttaacaggtctcccggctggggacccaaaaggaacaccaaacaccaacggcccctgttgtcgcccttgggacgccaagcgccggaggcctcagttggatccaccgggcgcgcaggcgacaatttcggacattctgcggagggcagaccaccacgggtgggcccacgccttgggacccccagggaaggctaacggaagggctcacatgttgaaaccgggcggacaggaaaaaacccttaagaggaacaggtctgggctagaatacggggcaagggctctggaagggacccagtgttccctgtggagggaaaaagctggcgggaattcgtggtccaacccacagatgaggattgccctcaatcccggcttccagcgaggaagccgcagggcttcaaggagatggctgggcctgggggagaacaggggggccaggggtttagacgagggtttgggccggccctggttttccgttccccaacaaaggaag

SEQ ID NO: 322692 - DNA, 2274 bp, Homo sapiens
caacaggaagcggcccctcccggcttcggagccgccgccactcgtctctgcccagctgctgccctccccaggaggcctccatggcttcacctacctccaccaacccagcgcatgcccactttgagagcttcctgcaggcccagctgtgccaggacgtgctgagcagcttccaggagctgtgtggggccctggggctggaacccggtggggggctgccccagtaccacaagatcaaggaccagctcaactactggagcgccaagtcactgtggaccaagctggacaagcgagcaggccagcctgtctaccagcagggccgggcctgcaccagcaccaagtgcctggtggtgggtgctggaccttgcgggctgcgggtcgctgtggagctggcgctgctgggggcccgagtggtgctggtggaaaagcgcaccaagttctctcgccacaacgtgctccacctctggcccttcaccatccacgacctgcgggcactcggtgctaagaagttctacgggcgcttctgcaccggcaccctggaccacatcagcatcaggcagctccagctgcttctgctgaaggtagcattgctgctgggggtggaaattcactggggtgtcactttcactggcctccagccccctcctaggaaggggagtggctggcgtgcccagctccaacccaacccccctgcccagctggccaactatgaatttgacgtccttatctcggctgcaggaggtaaattcgtccctgaaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggcattgatctggagaacattgtgtactacaaggacgacacccactactttgtgatgacagccaagaagcagtgcctgctgcggctgggggtgctgcgccaggactggccagacaccaatcggctgctgggcagtgccaatgtggtgcccgaggctctgcagcgctttacccgggcagctgctgactttgccacccatggcaagctcgggaaactagagtttgcccaggatgcccatgggcagcctgatgtctctgcctttgacttcacgagcatgatgcgggcagagagttctgctcgtgtgcaagagaagcatggcgcccgcctgctgctgggactggtgggggactgcctggtggagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtacgagacctgtatgatgtgctagccaaggagcctgtgcagaggaacaacgacaagacagatacagggatgccagccaccgggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggccctgtcagccaggcctccccagggacctccagtgctgtattattccttagtaaacttcagaggaccctgcagcgatcccgggccaaggaaaatgcagaggatgctggtggcaagaagctgcgcttggagatggaggccgagaccccaagtactgaggtgccacctgacccagagcctggtgtacccctgacacccccatcccaacaccaggaggccggtgctggggacctgtgtgcactttgtggggaacacctctatgtcctggaacgcctctgtgtcaaacgggggggccccgcccaacatttttttttttcccttttttttctcccaaaacccc

SEQ ID NO: 322693 - DNA, 501 bp, Homo sapiens
ggagtggctggcgtgcccagctccaacccaacccccctgcccagctggccaactatgaatttgacgtccttatctcggctgcaggaggtaaattcgtccctgaaggtgagtgatcacttccctcaaagaagccagcatctctggcacatcctgggcctttctagattgttataaccccctcctcctgccattgttcacctaccgccacctctaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggtcagggaccctcttgctgaatttcccctccccctgcctgactgtggcctggctcctgcctctcccttccaaacttgtcctcactgcaaggaactccacacttttctgtttttttggtctcagcagcaaag

SEQ ID NO: 322694 - DNA, 487 bp, Homo sapiens
ctagaggagcgtaccggatcccacccattgtgtgttaaacaacacatctcccagacacagaaacacactcactgggaaactactgcaaagtgaatagttcctgaaatgcttagctccttgtaagtctccaggagctactgttttaagaaaaccatttgtgcacttcttagcatgtgcttgttatcattacccatcagcaggctaggaggtgctttcgagaactgatagtgaccttgccttggtttgcctacgtatatactgttctaaaggtaaattcctccttactttggagaaatctcttgtatttctgtgtgccgtgagaattaatttgtgtttgaacagacttaggcttattcatattacctatgggatgaatccaaaatagtaaacattgcaggcttttcatctttatagttagaccaagtttattgctgaacaacttgggacgataattgctaatgtattttgcattttgatactaactctg

SEQ ID NO: 322695 - DNA, 332 bp, Homo sapiens
ctcaatcagcaatttaaaaggaacagctatagaagttgaacaacagtcgtactaaatggttcctaaggaagttatttttgaaaaagtataaatatcaacatgaaaaggtttcagaattcagtgtataagtgaaaaaaggacatgttcttggtttaataatcattttgttgcagagcacttttttcggaataaaaaaaatttgattatttcatttagggaagattaacaggaaatagtgttatcaaactgtgccctcagttttatagatgactcagtcttaaaaactccacacatcggaatgtgatgatgtgttcattagctgctctgtttga

SEQ ID NO: 322696 - DNA, 7264 bp, Homo sapiens
gcacgcggccaccgagctggaggaagcggcgggcgtgagaccgggaatgcttggggcccccgccttcctcgcagccatccagcactcggtgcacgccccgcgaggccagcggctgctccctcccggggctattgctgctagtgccgtgagcaccgcccagccattgtctctgtgtctccgtcagccgtgccgagccgcgcacccagaggcgagggcgcgcatggggagcctccgttgatgctgccgcggctgccgcgccgccctccgaggctgcgtcccggggagtccggcttcccgagcgctccggcctggcccggcgccccggacctgagtgcctccccatggaggcgcccgggccggcccaggcggccgcggcggagagcaactcccgagaggtgacggaggatgccgccgactgggcgcccgcgctctgccccagccccgaggcgcggtcgccggaggcgcctgcctaccgcctgcaggactgcgacgcgctggtcaccatgggcactgggacgttcgggcgggtgcacctggtgaaggagaagacagccaagcatttcttcgccctcaaggtgatgagcattcccgacgtcatccgccggaagcaggagcagcacgtgcacaatgagaagtctgtcctgaaggaagtcagccacccgttcctcatcaggctgttctggacgtggcatgaggagcgcttcctctacatgctcatggagtatgtgccgggtggcgagctcttcagctacctgcgcaaccgggggcacttctccagcaccacggggctcttctactctgcggagatcatctgtgccattgagtacctgcactccaaggagatcgtctacagggatttgaagccggagaacatcctgctggatagggatggtcacatcaagctcacggactttgggtttgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccattttttgatgacaacccgtttggcatttatcagaaaattcttgcaggcaaactatatttccccagacatttggatttccatgtaaaaacggggcgaatgatgtgaaacaccatcggtggttccgctccgtggactggaaagctgttccgcagagaaaactgaagcctcccatcgtgcccacgatagctggcaacggcgacacttccaacttcgaaacttaccctgagcatgactgggacacagccgcgcccgtgccgcagaaggatttagaaatcttcaagaatttctgaggacgagctcacatctggaagaaacaggaagattggaatctgcctggaacaaagaactgcacctaagcagaccagaagcaaaatgtcttcttcacggcctgaggacatttccagttttctctgtacctgtgtgtatagaaatagatcagagcacagttgaaattcatggaactggcattatttaagcaaccagaattccacactgtaggaaggttttgaaaattgtttcgttatagattttatcttatcttttggtgttgtcttggtttttctcatagactttataagtttgaactggacttatttgattataaccacaaattgtgtgtgtgtgtgtgtgtgtatatatagaagtcattatggcagatgcacaaattgtgcagtgatgtaaatatacatacttcacagagcctattatttttatttttcaattcagtttctcaaattatcttcccttctcttggggacaacatctgaagggtatgttgcatgcatttttaaaaaaatcatctcatatgcattgtatagtttgggggaataagatatccgggggccgggggtgtctacattcagtatctttagttcttcctacctagtaacttgagactttaaaagaagaaacatggagaagatgtgggagcgaatttattgcaggaatccacaatgactttgaagttgttggagcaatgcattgtattcagaaaacctgtgtcacattaaaaaatttcatctaggctaggtgcagtggcttgttcctgtagtcccagcactctgggaacctgggttgggaggattgcttaaggccaggagtttgagaccagcttgggcaacatagtgaaccctgtctgtatggaatttacacaaattataaaaattagtcgggtgtcattgtgcatacctgtagtcccagctattcaggagctgttgtaggagagattgcctgagctcaagaggttgaggctgcagtgagccctgattgtgccagtgcactccaggctggacgacagagcaagaccctgtattaaaaaaaaaattcatcctgcacagggaaatggctacctattaaagtcccagttgaaattttttgaaaaaatacacctcccacagttcacaaataacttttaagatcagctcatctataaggctgaccttcatgcagagattttatttcacctttagttttgggaaaagcgagaaacagatgatctataggatgtgagtgggtggcagagtcaaaaggaacctcacctgttcctaatttctccttttaaatattcatgttgagtgtgcctaatactctcctcgacaagtcatgctgttttatgcagaataatccaggcgtgagagtgttctcttgggaaatgactggggagacacctgaaaggagcaacccccagatgttcttccctgggtgttgatggcatgacagccatacagtgagtttgttctgaaacatctcttgctaaatgtgggtcatgctagacacagcataaactgagggtgtggggtctggctttgtacataactcattttctcccttgctttttctctggaccatcctggctggaaacttggctgtagacatctgaagagggtgcaccttttctctttactgtgactcacctcaaatatggcattgctcaaatctgctgtgtatgaggtcacagggcccagctgtggcaggggtgagtgcattgaagaagtaggttttggagccttccaggaattccttgttgacaacaggggtacactcacacagacctccaagactttcttctccacctcttctttttctcatgccctgccttcatctgtctccttctgcacccagagtaggggtggagtatacccttgccatgtgttagtgaaaatgtgtgcagtgagaagccagttgggtcccctcggctcctaatctcttctcaaaactcagtagctcaggttctctggagccatccggtgcattccttgctattggagctgtttttccaagcaatatctgggaagagatttctccctctagcacttgctacctctcttctgcacacatatcacacatcagtactgtggagagtttctgttaggaaaagccatacatttttaaaaatgtagcaaaatgtcaagggaaatgtaatcagatttggccagagttcgcctacagataagaaggcactgggccaggctcacacctgtaatcctaagtaacactttgggaggctggggcgagaggattgcttgagcccaggagttcaatacctgtctgggaaacacctcatctctacaaaatacaaaaaagttaactgggcatggtggagcatgcctgtagtctcagctactcaggaggctgagatgagaggatcacttgagcctgaggaggtccaggccacagtgatctgagatcacaccattgccctccagcctgggtgacagagtgagaccctgttccaaaaaaaaaaaaaaacccaaaaaacctcaatggctttttgcttttgaaggtggtatgaagagaacgtccactttaaggctttaaaagacagtgaagctggttgtagggctcacttttataatcctaggatttggggaagctgaagcagaaagattgcttgagcctgggagtttgagactggcctgggcagcatagcgagaccccatctctatataaaaaaaaagatgttaaaacagtgaaattacagaaacagaacatagccaccctgtttcatcagtgaccttttcttcacgtgacggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttactgtgaatgtgaaaaggtgaaactgttgctgacttcggtagcaggtatactaaaattggaatgacacagaggagattagcatggccccctgcgcgaggaagatccgcagattcatgcagcattccatatttttttaaaaaaaggttacactgtgcaccgacgtggagctagaaggaaaagcatgaagtctcatgtttgctgactataaaaataaatcatagtaataatattattgaacattctactttaaaaattattaataaaaccataaatgaaacacttgagcacactttaaaaagtacataaacccatgagtccatatgtgtaattttatgttgtctgttttattatccaggatttcatactcagatgagcattagcatcaggaaagcctgaaatgccttaattgtgaactgatacgcaggaaaatgaaatatgtaagcacattggtgaccttgttctttacagacatcatgatcagcctccagccatacagaacaaatgagaaattagaagcaattccaagaacgtgtgatggtgtgaacccacttttgaccgtcacacacatttcagcatttgaagagacacaggctacctggaaactgcccatggcggggtcataatttaaatgtcccaatgtcatatagaggttaatttaatcaaaatgagctaaaacatggaacaatcactgaataatttaaaaagagtttacctggcagagtgtgtcatgcctgcaatcccagcactttgggaggccaaggcaggcagatcacctgaggtcaggagtttgagaccagcctggccaacatgatgaaacccttgtctctattaaaaacacaaaaattagccagatgtggtggcacatgcctgtaatcccagttagtcgggaggctgaggcaggagaatatggaactcaggaggcggaggctgcagtcaaccaagattgcgccactgcactccagccagggcgaaggagtgagactcccatctcaaaaaataaaaaaaaaaataaataaaaatagttgacccgggtgggcattccaaaatgttcccatagatgatcgtgaaacaatcactgtgcaaaatgtagaggaaaattcttacgataatcacaaaatttgtatcagaaaaacattacaaatttactttgctccatgtaattttatgaattggcagtattttcttaaattgggatacagtaagagaatatctttaggaaatggaaatgttaaaacaagaagtaacaagaggttgtttttctgaagggaaatgccaccggcctgctttcataggcattgataaagccaggaaggaaataaagtcacaaccgaatagtatacactgtatctactgaattcttctaattccttcacaacagaagtctaaatcctgcttagcctaaacatatctatagccagcgatgggcaaattatatttgctgtcagcatgatggaataagaaacagaaaccccccagcagtggggtaagattgcacgcttcatcccctcaaaatgcagttcagccccactccctctccatgcccatcaaacaactgcaaaatcacttgttactgaatttctcattcagcgttttgtttctttctgtccatacttaaagaccaaattatttgtttgctttgaagaaaaagcaaaagcaacaaaaacaccaaatcatttgaaatccaaccttaacccaattaaaaaaaaattccaccagtggaactaaacagttgagtggtttgggatgtgttgttcgccatttctgtgtttgacctacatggtctctagttctttggacaattgtaactgtgaaactatggcttaacactgttaaagactccaaggctccactctgtagccaggtgcaactcaggctgcacaaataccccaccagaatgtcacaatcattcattgctccagctgctgagtgaacagagtgcaagacagcactggcttgggttttatttttgcagccagttaactttgcatcaggtctacacagtccttgcagcctttgatttctccagttgtacagatttgaaatggggtgcccgggttcctctcgtttttccttcaatctacctagcatgcattttacacacattggaggagtcgatgcactgtttttctcttgctgatggaggcaagaacgccttctaattagtataacttaaatggacgggattgacttaaaagcaagaagaaaagcacatgaacaggtgtcttaatgcatttggatactttggggtgtgtgcctgtctgtgtgtgtgtcttggtgaaggtgggctgtattttcaccaagccttttcataatcaagtttgctttgcaaaccatctggccttgcccccagcagtacagtccttcctaataacggggatgctctgtcatgtttctctgtaaattgttgtgtgttgggaagttctgttgaggcttagtttgatcttccatggtggacatgtctgttctgtatataaaaagcattacatctgtgttttagcaggtgggatttgaagcttttccacagtccttgtgctctgagatggctgttgagctctgctcagctgtcacagctgaattctttttttgtgctgaacactgggcagcctcaccttgttgccaacgtgcttctggggcccctgtgactgctgccggatgctgtgcacacaggcagagtgccttggcaggtttgtgcaccccttggcgagccagaactgggaaccccgcggagtgaccccaccttctcatggggggtcagggaggggagtgcctatttttaatcttgtttgttgcgcaatggaaatcactgtgatttgtacatatgccctaggaaaattttaccgctgtctaatttatgtaataatactgatgattctaggtttgtttaataaaactttatatcttttcagaagcaaggctccactctgtagccaggtgcaactcaggctgca

SEQ ID NO: 322697 - DNA, 6521 bp, Homo sapiens
taggtggaaagctgacgtggacgaaggctgttccgcagagaaaactgaagcctcccatcgtgcccacgatagctggcaacggcgacacttccaacttcgaaacttaccctgagcatgactgggacacagccgcgcccgtgccgcagaaggatttagaaatcttcaagaatttctgaggacgagctcacatctggaaggacttggaccctctgtggaacacccgagtacctagcccccgaagtcattcagagcaagggccacggaagggccgtggactggtgggccctcggcatcctgatattcgagatgctttcggggtttcctccattttttgatgacaacccgtttggcatttatcagaaaattcttgcaggcaaactatatttccccagacatttggatttccatgtaaaaacggggcgaatgatgtgaaacaccatcggtggttccgctccgtggactggaaagctgttccgcagagaaaactgaagcctcccatcgtgcccacgatagctggcaacggcgacacttccaacttcgaaacttaccctgagcatgactgggacacagccgcgcccgtgccgcagaaggatttagaaatcttcaagaatttctgaggacgagctcacatctggaagaaacaggaagattggaatctgcctggaacaaagaactgcacctaagcagaccagaagcaaaatgtcttcttcacggcctgaggacatttccagttttctctgtacctgtgtgtatagaaatagatcagagcacagttgaaattcatggaactggcattatttaagcaaccagaattccacactgtaggaaggttttgaaaattgtttcgttatagattttatcttatcttttggtgttgtcttggtttttctcatagactttataagtttgaactggacttatttgattataaccacaaattgtgtgtgtgtgtgtgtgtgtatatatagaagtcattatggcagatgcacaaattgtgcagtgatgtaaatatacatacttcacagagcctattatttttatttttcaattcagtttctcaaattatcttcccttctcttggggacaacatctgaagggtatgttgcatgcatttttaaaaaaatcatctcatatgcattgtatagtttgggggaataagatatccgggggccgggggtgtctacattcagtatctttagttcttcctacctagtaacttgagactttaaaagaagaaacatggagaagatgtgggagcgaatttattgcaggaatccacaatgactttgaagttgttggagcaatgcattgtattcagaaaacctgtgtcacattaaaaaatttcatctaggctaggtgcagtggcttgttcctgtagtcccagcactctgggaacctgggttgggaggattgcttaaggccaggagtttgagaccagcttgggcaacatagtgaaccctgtctgtatggaatttacacaaattataaaaattagtcgggtgtcattgtgcatacctgtagtcccagctattcaggagctgttgtaggagagattgcctgagctcaagaggttgaggctgcagtgagccctgattgtgccagtgcactccaggctggacgacagagcaagaccctgtattaaaaaaaaaattcatcctgcacagggaaatggctacctattaaagtcccagttgaaattttttgaaaaaatacacctcccacagttcacaaataacttttaagatcagctcatctataaggctgaccttcatgcagagattttatttcacctttagttttgggaaaagcgagaaacagatgatctataggatgtgagtgggtggcagagtcaaaaggaacctcacctgttcctaatttctccttttaaatattcatgttgagtgtgcctaatactctcctcgacaagtcatgctgttttatgcagaataatccaggcgtgagagtgttctcttgggaaatgactggggagacacctgaaaggagcaacccccagatgttcttccctgggtgttgatggcatgacagccatacagtgagtttgttctgaaacatctcttgctaaatgtgggtcatgctagacacagcataaactgagggtgtggggtctggctttgtacataactcattttctcccttgctttttctctggaccatcctggctggaaacttggctgtagacatctgaagagggtgcaccttttctctttactgtgactcacctcaaatatggcattgctcaaatctgctgtgtatgaggtcacagggcccagctgtggcaggggtgagtgcattgaagaagtaggttttggagccttccaggaattccttgttgacaacaggggtacactcacacagacctccaagactttcttctccacctcttctttttctcatgccctgccttcatctgtctccttctgcacccagagtaggggtggagtatacccttgccatgtgttagtgaaaatgtgtgcagtgagaagccagttgggtcccctcggctcctaatctcttctcaaaactcagtagctcaggttctctggagccatccggtgcattccttgctattggagctgtttttccaagcaatatctgggaagagatttctccctctagcacttgctacctctcttctgcacacatatcacacatcagtactgtggagagtttctgttaggaaaagccatacatttttaaaaatgtagcaaaatgtcaagggaaatgtaatcagatttggccagagttcgcctacagataagaaggcactgggccaggctcacacctgtaatcctaagtaacactttgggaggctggggcgagaggattgcttgagcccaggagttcaatacctgtctgggaaacacctcatctctacaaaatacaaaaaagttaactgggcatggtggagcatgcctgtagtctcagctactcaggaggctgagatgagaggatcacttgagcctgaggaggtccaggccacagtgatctgagatcacaccattgccctccagcctgggtgacagagtgagaccctgttccaaaaaaaaaaaaaaacccaaaaaacctcaatggctttttgcttttgaaggtggtatgaagagaacgtccactttaaggctttaaaagacagtgaagctggttgtagggctcacttttataatcctaggatttggggaagctgaagcagaaagattgcttgagcctgggagtttgagactggcctgggcagcatagcgagaccccatctctatataaaaaaaaagatgttaaaacagtgaaattacagaaacagaacatagccaccctgtttcatcagtgaccttttcttcacgtgacggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttactgtgaatgtgaaaaggtgaaactgttgctgacttcggtagcaggtatactaaaattggaatgacacagaggagattagcatggccccctgcgcgaggaagatccgcagattcatgcagcattccatatttttttaaaaaaaggttacactgtgcaccgacgtggagctagaaggaaaagcatgaagtctcatgtttgctgactataaaaataaatcatagtaataatattattgaacattctactttaaaaattattaataaaaccataaatgaaacacttgagcacactttaaaaagtacataaacccatgagtccatatgtgtaattttatgttgtctgttttattatccaggatttcatactcagatgagcattagcatcaggaaagcctgaaatgccttaattgtgaactgatacgcaggaaaatgaaatatgtaagcacattggtgaccttgttctttacagacatcatgatcagcctccagccatacagaacaaatgagaaattagaagcaattccaagaacgtgtgatggtgtgaacccacttttgaccgtcacacacatttcagcatttgaagagacacaggctacctggaaactgcccatggcggggtcataatttaaatgtcccaatgtcatatagaggttaatttaatcaaaatgagctaaaacatggaacaatcactgaataatttaaaaagagtttacctggcagagtgtgtcatgcctgcaatcccagcactttgggaggccaaggcaggcagatcacctgaggtcaggagtttgagaccagcctggccaacatgatgaaacccttgtctctattaaaaacacaaaaattagccagatgtggtggcacatgcctgtaatcccagttagtcgggaggctgaggcaggagaatatggaactcaggaggcggaggctgcagtcaaccaagattgcgccactgcactccagccagggcgaaggagtgagactcccatctcaaaaaataaaaaaaaaaataaataaaaatagttgacccgggtgggcattccaaaatgttcccatagatgatcgtgaaacaatcactgtgcaaaatgtagaggaaaattcttacgataatcacaaaatttgtatcagaaaaacattacaaatttactttgctccatgtaattttatgaattggcagtattttcttaaattgggatacagtaagagaatatctttaggaaatggaaatgttaaaacaagaagtaacaagaggttgtttttctgaagggaaatgccaccggcctgctttcataggcattgataaagccaggaaggaaataaagtcacaaccgaatagtatacactgtatctactgaattcttctaattccttcacaacagaagtctaaatcctgcttagcctaaacatatctatagccagcgatgggcaaattatatttgctgtcagcatgatggaataagaaacagaaaccccccagcagtggggtaagattgcacgcttcatcccctcaaaatgcagttcagccccactccctctccatgcccatcaaacaactgcaaaatcacttgttactgaatttctcattcagcgttttgtttctttctgtccatacttaaagaccaaattatttgtttgctttgaagaaaaagcaaaagcaacaaaaacaccaaatcatttgaaatccaaccttaacccaattaaaaaaaaattccaccagtggaactaaacagttgagtggtttgggatgtgttgttcgccatttctgtgtttgacctacatggtctctagttctttggacaattgtaactgtgaaactatggcttaacactgttaaagactccaaggctccactctgtagccaggtgcaactcaggctgcacaaataccccaccagaatgtcacaatcattcattgctccagctgctgagtgaacagagtgcaagacagcactggcttgggttttatttttgcagccagttaactttgcatcaggtctacacagtccttgcagcctttgatttctccagttgtacagatttgaaatggggtgcccgggttcctctcgtttttccttcaatctacctagcatgcattttacacacattggaggagtcgatgcactgtttttctcttgctgatggaggcaagaacgccttctaattagtataacttaaatggacgggattgacttaaaagcaagaagaaaagcacatgaacaggtgtcttaatgcatttggatactttggggtgtgtgcctgtctgtgtgtgtgtcttggtgaaggtgggctgtattttcaccaagccttttcataatcaagtttgctttgcaaaccatctggccttgcccccagcagtacagtccttcctaataacggggatgctctgtcatgtttctctgtaaattgttgtgtgttgggaagttctgttgaggcttagtttgatcttccatggtggacatgtctgttctgtatataaaaagcattacatctgtgttttagcaggtgggatttgaagcttttccacagtccttgtgctctgagatggctgttgagctctgctcagctgtcacagctgaattctttttttgtgctgaacactgggcagcctcaccttgttgccaacgtgcttctggggcccctgtgactgctgccggatgctgtgcacacaggcagagtgccttggcaggtttgtgcaccccttggcgagccagaactgggaaccccgcggagtgaccccaccttctcatggggggtcagggaggggagtgcctatttttaatcttgtttgttgcgcaatggaaatcactgtgatttgtacatatgccctaggaaaattttaccgctgtctaatttatgtaataatactgatgattctaggtttgtttaataaaactttatatcttttcagaagcaaggctccactctgtagccaggtgcaactcaggctgca

SEQ ID NO: 322698 - DNA, 6435 bp, Homo sapiens
ggagcgtggttttactcaacgaagttattgtaacaatcagagcttctaaggtgactgcattagccaagcaccactgagtgttgtgggggcctgtctctgtcgcccatataggacttggaccctctgtggaacacccgagtacctagcccccgaagtcattcagagcaagggccacggaagggccgtggactggtgggccctcggcatcctgatattcgagatgctttcggggtttcctccattttttgatgacaacccgtttggcatttatcagaaaattcttgcaggcaaactatatttccccagacatttggatttccatgtaaaaacggggcgaatgatgtgaaacaccatcggtggttccgctccgtggactggaaagctgttccgcagagaaaactgaagcctcccatcgtgcccacgatagctggcaacggcgacacttccaacttcgaaacttaccctgagcatgactgggacacagccgcgcccgtgccgcagaaggatttagaaatcttcaagaatttctgaggacgagctcacatctggaagaaacaggaagattggaatctgcctggaacaaagaactgcacctaagcagaccagaagcaaaatgtcttcttcacggcctgaggacatttccagttttctctgtacctgtgtgtatagaaatagatcagagcacagttgaaattcatggaactggcattatttaagcaaccagaattccacactgtaggaaggttttgaaaattgtttcgttatagattttatcttatcttttggtgttgtcttggtttttctcatagactttataagtttgaactggacttatttgattataaccacaaattgtgtgtgtgtgtgtgtgtgtatatatagaagtcattatggcagatgcacaaattgtgcagtgatgtaaatatacatacttcacagagcctattatttttatttttcaattcagtttctcaaattatcttcccttctcttggggacaacatctgaagggtatgttgcatgcatttttaaaaaaatcatctcatatgcattgtatagtttgggggaataagatatccgggggccgggggtgtctacattcagtatctttagttcttcctacctagtaacttgagactttaaaagaagaaacatggagaagatgtgggagcgaatttattgcaggaatccacaatgactttgaagttgttggagcaatgcattgtattcagaaaacctgtgtcacattaaaaaatttcatctaggctaggtgcagtggcttgttcctgtagtcccagcactctgggaacctgggttgggaggattgcttaaggccaggagtttgagaccagcttgggcaacatagtgaaccctgtctgtatggaatttacacaaattataaaaattagtcgggtgtcattgtgcatacctgtagtcccagctattcaggagctgttgtaggagagattgcctgagctcaagaggttgaggctgcagtgagccctgattgtgccagtgcactccaggctggacgacagagcaagaccctgtattaaaaaaaaaattcatcctgcacagggaaatggctacctattaaagtcccagttgaaattttttgaaaaaatacacctcccacagttcacaaataacttttaagatcagctcatctataaggctgaccttcatgcagagattttatttcacctttagttttgggaaaagcgagaaacagatgatctataggatgtgagtgggtggcagagtcaaaaggaacctcacctgttcctaatttctccttttaaatattcatgttgagtgtgcctaatactctcctcgacaagtcatgctgttttatgcagaataatccaggcgtgagagtgttctcttgggaaatgactggggagacacctgaaaggagcaacccccagatgttcttccctgggtgttgatggcatgacagccatacagtgagtttgttctgaaacatctcttgctaaatgtgggtcatgctagacacagcataaactgagggtgtggggtctggctttgtacataactcattttctcccttgctttttctctggaccatcctggctggaaacttggctgtagacatctgaagagggtgcaccttttctctttactgtgactcacctcaaatatggcattgctcaaatctgctgtgtatgaggtcacagggcccagctgtggcaggggtgagtgcattgaagaagtaggttttggagccttccaggaattccttgttgacaacaggggtacactcacacagacctccaagactttcttctccacctcttctttttctcatgccctgccttcatctgtctccttctgcacccagagtaggggtggagtatacccttgccatgtgttagtgaaaatgtgtgcagtgagaagccagttgggtcccctcggctcctaatctcttctcaaaactcagtagctcaggttctctggagccatccggtgcattccttgctattggagctgtttttccaagcaatatctgggaagagatttctccctctagcacttgctacctctcttctgcacacatatcacacatcagtactgtggagagtttctgttaggaaaagccatacatttttaaaaatgtagcaaaatgtcaagggaaatgtaatcagatttggccagagttcgcctacagataagaaggcactgggccaggctcacacctgtaatcctaagtaacactttgggaggctggggcgagaggattgcttgagcccaggagttcaatacctgtctgggaaacacctcatctctacaaaatacaaaaaagttaactgggcatggtggagcatgcctgtagtctcagctactcaggaggctgagatgagaggatcacttgagcctgaggaggtccaggccacagtgatctgagatcacaccattgccctccagcctgggtgacagagtgagaccctgttccaaaaaaaaaaaaaaacccaaaaaacctcaatggctttttgcttttgaaggtggtatgaagagaacgtccactttaaggctttaaaagacagtgaagctggttgtagggctcacttttataatcctaggatttggggaagctgaagcagaaagattgcttgagcctgggagtttgagactggcctgggcagcatagcgagaccccatctctatataaaaaaaaagatgttaaaacagtgaaattacagaaacagaacatagccaccctgtttcatcagtgaccttttcttcacgtgacggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttactgtgaatgtgaaaaggtgaaactgttgctgacttcggtagcaggtatactaaaattggaatgacacagaggagattagcatggccccctgcgcgaggaagatccgcagattcatgcagcattccatatttttttaaaaaaaggttacactgtgcaccgacgtggagctagaaggaaaagcatgaagtctcatgtttgctgactataaaaataaatcatagtaataatattattgaacattctactttaaaaattattaataaaaccataaatgaaacacttgagcacactttaaaaagtacataaacccatgagtccatatgtgtaattttatgttgtctgttttattatccaggatttcatactcagatgagcattagcatcaggaaagcctgaaatgccttaattgtgaactgatacgcaggaaaatgaaatatgtaagcacattggtgaccttgttctttacagacatcatgatcagcctccagccatacagaacaaatgagaaattagaagcaattccaagaacgtgtgatggtgtgaacccacttttgaccgtcacacacatttcagcatttgaagagacacaggctacctggaaactgcccatggcggggtcataatttaaatgtcccaatgtcatatagaggttaatttaatcaaaatgagctaaaacatggaacaatcactgaataatttaaaaagagtttacctggcagagtgtgtcatgcctgcaatcccagcactttgggaggccaaggcaggcagatcacctgaggtcaggagtttgagaccagcctggccaacatgatgaaacccttgtctctattaaaaacacaaaaattagccagatgtggtggcacatgcctgtaatcccagttagtcgggaggctgaggcaggagaatatggaactcaggaggcggaggctgcagtcaaccaagattgcgccactgcactccagccagggcgaaggagtgagactcccatctcaaaaaataaaaaaaaaaataaataaaaatagttgacccgggtgggcattccaaaatgttcccatagatgatcgtgaaacaatcactgtgcaaaatgtagaggaaaattcttacgataatcacaaaatttgtatcagaaaaacattacaaatttactttgctccatgtaattttatgaattggcagtattttcttaaattgggatacagtaagagaatatctttaggaaatggaaatgttaaaacaagaagtaacaagaggttgtttttctgaagggaaatgccaccggcctgctttcataggcattgataaagccaggaaggaaataaagtcacaaccgaatagtatacactgtatctactgaattcttctaattccttcacaacagaagtctaaatcctgcttagcctaaacatatctatagccagcgatgggcaaattatatttgctgtcagcatgatggaataagaaacagaaaccccccagcagtggggtaagattgcacgcttcatcccctcaaaatgcagttcagccccactccctctccatgcccatcaaacaactgcaaaatcacttgttactgaatttctcattcagcgttttgtttctttctgtccatacttaaagaccaaattatttgtttgctttgaagaaaaagcaaaagcaacaaaaacaccaaatcatttgaaatccaaccttaacccaattaaaaaaaaattccaccagtggaactaaacagttgagtggtttgggatgtgttgttcgccatttctgtgtttgacctacatggtctctagttctttggacaattgtaactgtgaaactatggcttaacactgttaaagactccaaggctccactctgtagccaggtgcaactcaggctgcacaaataccccaccagaatgtcacaatcattcattgctccagctgctgagtgaacagagtgcaagacagcactggcttgggttttatttttgcagccagttaactttgcatcaggtctacacagtccttgcagcctttgatttctccagttgtacagatttgaaatggggtgcccgggttcctctcgtttttccttcaatctacctagcatgcattttacacacattggaggagtcgatgcactgtttttctcttgctgatggaggcaagaacgccttctaattagtataacttaaatggacgggattgacttaaaagcaagaagaaaagcacatgaacaggtgtcttaatgcatttggatactttggggtgtgtgcctgtctgtgtgtgtgtcttggtgaaggtgggctgtattttcaccaagccttttcataatcaagtttgctttgcaaaccatctggccttgcccccagcagtacagtccttcctaataacggggatgctctgtcatgtttctctgtaaattgttgtgtgttgggaagttctgttgaggcttagtttgatcttccatggtggacatgtctgttctgtatataaaaagcattacatctgtgttttagcaggtgggatttgaagcttttccacagtccttgtgctctgagatggctgttgagctctgctcagctgtcacagctgaattctttttttgtgctgaacactgggcagcctcaccttgttgccaacgtgcttctggggcccctgtgactgctgccggatgctgtgcacacaggcagagtgccttggcaggtttgtgcaccccttggcgagccagaactgggaaccccgcggagtgaccccaccttctcatggggggtcagggaggggagtgcctatttttaatcttgtttgttgcgcaatggaaatcactgtgatttgtacatatgccctaggaaaattttaccgctgtctaatttatgtaataatactgatgattctaggtttgtttaataaaactttatatcttttcagaagcaaggctccactctgtagccaggtgcaactcaggctgca

SEQ ID NO: 322699 - DNA, 3521 bp, Homo sapiens
ggcccagaggttcccaattcgggcccgggtccccgacccacccggggggcccccccaaaaaaaaaaaaaaaaaaacccaaaaaacctcaatggctttttgcttttgaaggtggtatgaagagaacgtccactttaaggctttaaaagacagtgaagctggttgtagggctcacttttataatcctaggatttggggaagctgaagcagaaagattgcttgagcctgggagtttgagactggcctgggcagcatagcgagaccccatctctatataaaaaaaaagatgttaaaacagtgaaattacagaaacagaacatagccaccctgtttcatcagtgaccttttcttcacgtgacggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttactgtgaatgtgaaaaggtgaaactgttgctgacttcggtagcaggtatactaaaattggaatgacacagaggagattagcatggccccctgcgcgaggaagatccgcagattcatgcagcattccatatttttttaaaaaaaggttacactgtgcaccgacgtggagctagaaggaaaagcatgaagtctcatgtttgctgactataaaaataaatcatagtaataatattattgaacattctactttaaaaattattaataaaaccataaatgaaacacttgagcacactttaaaaagtacataaacccatgagtccatatgtgtaattttatgttgtctgttttattatccaggatttcatactcagatgagcattagcatcaggaaagcctgaaatgccttaattgtgaactgatacgcaggaaaatgaaatatgtaagcacattggtgaccttgttctttacagacatcatgatcagcctccagccatacagaacaaatgagaaattagaagcaattccaagaacgtgtgatggtgtgaacccacttttgaccgtcacacacatttcagcatttgaagagacacaggctacctggaaactgcccatggcggggtcataatttaaatgtcccaatgtcatatagaggttaatttaatcaaaatgagctaaaacatggaacaatcactgaataatttaaaaagagtttacctggcagagtgtgtcatgcctgcaatcccagcactttgggaggccaaggcaggcagatcacctgaggtcaggagtttgagaccagcctggccaacatgatgaaacccttgtctctattaaaaacacaaaaattagccagatgtggtggcacatgcctgtaatcccagttagtcgggaggctgaggcaggagaatatggaactcaggaggcggaggctgcagtcaaccaagattgcgccactgcactccagccagggcgaaggagtgagactcccatctcaaaaaataaaaaaaaaaataaataaaaatagttgacccgggtgggcattccaaaatgttcccatagatgatcgtgaaacaatcactgtgcaaaatgtagaggaaaattcttacgataatcacaaaatttgtatcagaaaaacattacaaatttactttgctccatgtaattttatgaattggcagtattttcttaaattgggatacagtaagagaatatctttaggaaatggaaatgttaaaacaagaagtaacaagaggttgtttttctgaagggaaatgccaccggcctgctttcataggcattgataaagccaggaaggaaataaagtcacaaccgaatagtatacactgtatctactgaattcttctaattccttcacaacagaagtctaaatcctgcttagcctaaacatatctatagccagcgatgggcaaattatatttgctgtcagcatgatggaataagaaacagaaaccccccagcagtggggtaagattgcacgcttcatcccctcaaaatgcagttcagccccactccctctccatgcccatcaaacaactgcaaaatcacttgttactgaatttctcattcagcgttttgtttctttctgtccatacttaaagaccaaattatttgtttgctttgaagaaaaagcaaaagcaacaaaaacaccaaatcatttgaaatccaaccttaacccaattaaaaaaaaattccaccagtggaactaaacagttgagtggtttgggatgtgttgttcgccatttctgtgtttgacctacatggtctctagttctttggacaattgtaactgtgaaactatggcttaacactgttaaagactccaaggctccactctgtagccaggtgcaactcaggctgcacaaataccccaccagaatgtcacaatcattcattgctccagctgctgagtgaacagagtgcaagacagcactggcttgggttttatttttgcagccagttaactttgcatcaggtctacacagtccttgcagcctttgatttctccagttgtacagatttgaaatggggtgcccgggttcctctcgtttttccttcaatctacctagcatgcattttacacacattggaggagtcgatgcactgtttttctcttgctgatggaggcaagaacgccttctaattagtataacttaaatggacgggattgacttaaaagcaagaagaaaagcacatgaacaggtgtcttaatgcatttggatactttggggtgtgtgcctgtctgtgtgtgtgtcttggtgaaggtgggctgtattttcaccaagccttttcataatcaagtttgctttgcaaaccatctggccttgcccccagcagtacagtccttcctaataacggggatgctctgtcatgtttctctgtaaattgttgtgtgttgggaagttctgttgaggcttagtttgatcttccatggtggacatgtctgttctgtatataaaaagcattacatctgtgttttagcaggtgggatttgaagcttttccacagtccttgtgctctgagatggctgttgagctctgctcagctgtcacagctgaattctttttttgtgctgaacactgggcagcctcaccttgttgccaacgtgcttctggggcccctgtgactgctgccggatgctgtgcacacaggcagagtgccttggcaggtttgtgcaccccttggcgagccagaactgggaaccccgcggagtgaccccaccttctcatggggggtcagggaggggagtgcctatttttaatcttgtttgttgcgcaatggaaatcactgtgatttgtacatatgccctaggaaaattttaccgctgtctaatttatgtaataatactgatgattctaggtttgtttaataaaactttatatcttttcagaagcaaggctccactctgtagccaggtgcaactcaggctgca

SEQ ID NO: 322700 - DNA, 1408 bp, Homo sapiens
gcacgcggccaccgagctggaggaagcggcgggcgtgagaccgggaatgcttggggcccccgccttcctcgcagccatccagcactcggtgcacgccccgcgaggccagcggctgctccctcccggggctattgctgctagtgccgtgagcaccgcccagccattgtctctgtgtctccgtcagccgtgccgagccgcgcacccagaggcgagggcgcgcatggggagcctccgttgatgctgccgcggctgccgcgccgccctccgaggctgcgtcccggggagtccggcttcccgagcgctccggcctggcccggcgccccggacctgagtgcctccccatggaggcgcccgggccggcccaggcggccgcggcggagagcaactcccgagaggtgacggaggatgccgccgactgggcgcccgcgctctgccccagccccgaggcgcggtcgccggaggcgcctgcctaccgcctgcaggactgcgacgcgctggtcaccatgggcactgggacgttcgggcgggtgcacctggtgaaggagaagacagccaagcatttcttcgccctcaaggtgatgagcattcccgacgtcatccgccggaagcaggagcagcacgtgcacaatgagaagtctgtcctgaaggaagtcagccacccgttcctcatcaggctgttctggacgtggcatgaggagcgcttcctctacatgctcatggagtatgtgccgggtggcgagctcttcagctacctgcgcaaccgggggcacttctccagcaccacggggctcttctactctgcggagatcatctgtgccattgagtacctgcactccaaggagatcgtctacagggatttgaagccggagaacatcctgctggatagggatggtcacatcaagctcacggactttgggtttgccaagaagctggtagacagacagggtctcatcctgtcacccaagctgaagtgccgttgcacaatcttgtctcactacagcctcaaactcctcggctcaagtgatcctccctcctcagcctctgaagtagctgggactacaggcatgtgccaccataccaggctaatttttttatttttaattttagagatgtgatctcactttattgctcaggctggtcttgaactcttggccccaagatatcgtcccacctcagcttcccaaagcactggaattagaagcatgtgccactgtgcctggccaattctatttttgaatttaacatttttagcaccagacagttgttaaatcagtatcattttattatttgtttatttatttagatggagtctgcactccagcctgggcaacagaatggactctgtctccaaaaaaagaaaaaataaataaagaaaagtcattctgtagttttagcctttgtgaaggca

SEQ ID NO: 322701 - DNA, 524 bp, Homo sapiens
ggagcgtggttttactcaacgaagttattgtaacaatcagagcttctaaggtgactgcattagccaagcaccactgagtgttgtgggggcctgtctctgtcgcccatataggacttggaccctctgtggaacacccgagtacctagcccccgaagtcattcagagcaagggccacggaagggccgtggactggtgggccctcggcatcctgatattcgagatgctttcgggctgtgcacacaggcagagtgccttggcaggtttgtgcaccccttggcgagccagaactgggaaccccgcggagtgaccccaccttctcatggggggtcagggaggggagtgcctatttttaatcttgtttgttgcgcaatggaaatcactgtgatttgtacatatgccctaggaaaattttaccgctgtctaatttatgtaataatactgatgattctaggtttgtttaataaaactttatatcttttcagaagcaaggctccactctgtagccaggtgcaactcaggctgca

SEQ ID NO: 322702 - DNA, 6972 bp, Homo sapiens
ctccaggcaagtccccgtccaaaaagaagaagaagttccgtaccccgtcctttctgaagaagagcaaggagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcaccatgggcactgggacgttcgggcgggtgcacctggtgaaggagaagacagccaagcatttcttcgccctcaaggtgatgagcattcccgacgtcatccgccggaagcaggagcagcacgtgcacaatgagaagtctgtcctgaaggaagtcagccacccgttcctcatcaggctgttctggacgtggcatgaggagcgcttcctctacatgctcatggagtatgtgccgggtggcgagctcttcagctacctgcgcaaccgggggcacttctccagcaccacggggctcttctactctgcggagatcatctgtgccattgagtacctgcactccaaggagatcgtctacagggatttgaagccggagaacatcctgctggatagggatggtcacatcaagctcacggactttgggtttgccaagaagctggtagacaggacttggaccctctgtggaacacccgagtacctagcccccgaagtcattcagagcaagggccacggaagggccgtggactggtgggccctcggcatcctgatattcgagatgctttcggggtttcctccattttttgatgacaacccgtttggcatttatcagaaaattcttgcaggcaaactatatttccccagacatttggatttccatgtaaaaacggggcgaatgatgtgaaacaccatcggtggttccgctccgtggactggaaagctgttccgcagagaaaactgaagcctcccatcgtgcccacgatagctggcaacggcgacacttccaacttcgaaacttaccctgagcatgactgggacacagccgcgcccgtgccgcagaaggatttagaaatcttcaagaatttctgaggacgagctcacatctggaagaaacaggaagattggaatctgcctggaacaaagaactgcacctaagcagaccagaagcaaaatgtcttcttcacggcctgaggacatttccagttttctctgtacctgtgtgtatagaaatagatcagagcacagttgaaattcatggaactggcattatttaagcaaccagaattccacactgtaggaaggttttgaaaattgtttcgttatagattttatcttatcttttggtgttgtcttggtttttctcatagactttataagtttgaactggacttatttgattataaccacaaattgtgtgtgtgtgtgtgtgtgtatatatagaagtcattatggcagatgcacaaattgtgcagtgatgtaaatatacatacttcacagagcctattatttttatttttcaattcagtttctcaaattatcttcccttctcttggggacaacatctgaagggtatgttgcatgcatttttaaaaaaatcatctcatatgcattgtatagtttgggggaataagatatccgggggccgggggtgtctacattcagtatctttagttcttcctacctagtaacttgagactttaaaagaagaaacatggagaagatgtgggagcgaatttattgcaggaatccacaatgactttgaagttgttggagcaatgcattgtattcagaaaacctgtgtcacattaaaaaatttcatctaggctaggtgcagtggcttgttcctgtagtcccagcactctgggaacctgggttgggaggattgcttaaggccaggagtttgagaccagcttgggcaacatagtgaaccctgtctgtatggaatttacacaaattataaaaattagtcgggtgtcattgtgcatacctgtagtcccagctattcaggagctgttgtaggagagattgcctgagctcaagaggttgaggctgcagtgagccctgattgtgccagtgcactccaggctggacgacagagcaagaccctgtattaaaaaaaaaattcatcctgcacagggaaatggctacctattaaagtcccagttgaaattttttgaaaaaatacacctcccacagttcacaaataacttttaagatcagctcatctataaggctgaccttcatgcagagattttatttcacctttagttttgggaaaagcgagaaacagatgatctataggatgtgagtgggtggcagagtcaaaaggaacctcacctgttcctaatttctccttttaaatattcatgttgagtgtgcctaatactctcctcgacaagtcatgctgttttatgcagaataatccaggcgtgagagtgttctcttgggaaatgactggggagacacctgaaaggagcaacccccagatgttcttccctgggtgttgatggcatgacagccatacagtgagtttgttctgaaacatctcttgctaaatgtgggtcatgctagacacagcataaactgagggtgtggggtctggctttgtacataactcattttctcccttgctttttctctggaccatcctggctggaaacttggctgtagacatctgaagagggtgcaccttttctctttactgtgactcacctcaaatatggcattgctcaaatctgctgtgtatgaggtcacagggcccagctgtggcaggggtgagtgcattgaagaagtaggttttggagccttccaggaattccttgttgacaacaggggtacactcacacagacctccaagactttcttctccacctcttctttttctcatgccctgccttcatctgtctccttctgcacccagagtaggggtggagtatacccttgccatgtgttagtgaaaatgtgtgcagtgagaagccagttgggtcccctcggctcctaatctcttctcaaaactcagtagctcaggttctctggagccatccggtgcattccttgctattggagctgtttttccaagcaatatctgggaagagatttctccctctagcacttgctacctctcttctgcacacatatcacacatcagtactgtggagagtttctgttaggaaaagccatacatttttaaaaatgtagcaaaatgtcaagggaaatgtaatcagatttggccagagttcgcctacagataagaaggcactgggccaggctcacacctgtaatcctaagtaacactttgggaggctggggcgagaggattgcttgagcccaggagttcaatacctgtctgggaaacacctcatctctacaaaatacaaaaaagttaactgggcatggtggagcatgcctgtagtctcagctactcaggaggctgagatgagaggatcacttgagcctgaggaggtccaggccacagtgatctgagatcacaccattgccctccagcctgggtgacagagtgagaccctgttccaaaaaaaaaaaaaaacccaaaaaacctcaatggctttttgcttttgaaggtggtatgaagagaacgtccactttaaggctttaaaagacagtgaagctggttgtagggctcacttttataatcctaggatttggggaagctgaagcagaaagattgcttgagcctgggagtttgagactggcctgggcagcatagcgagaccccatctctatataaaaaaaaagatgttaaaacagtgaaattacagaaacagaacatagccaccctgtttcatcagtgaccttttcttcacgtgacggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttactgtgaatgtgaaaaggtgaaactgttgctgacttcggtagcaggtatactaaaattggaatgacacagaggagattagcatggccccctgcgcgaggaagatccgcagattcatgcagcattccatatttttttaaaaaaaggttacactgtgcaccgacgtggagctagaaggaaaagcatgaagtctcatgtttgctgactataaaaataaatcatagtaataatattattgaacattctactttaaaaattattaataaaaccataaatgaaacacttgagcacactttaaaaagtacataaacccatgagtccatatgtgtaattttatgttgtctgttttattatccaggatttcatactcagatgagcattagcatcaggaaagcctgaaatgccttaattgtgaactgatacgcaggaaaatgaaatatgtaagcacattggtgaccttgttctttacagacatcatgatcagcctccagccatacagaacaaatgagaaattagaagcaattccaagaacgtgtgatggtgtgaacccacttttgaccgtcacacacatttcagcatttgaagagacacaggctacctggaaactgcccatggcggggtcataatttaaatgtcccaatgtcatatagaggttaatttaatcaaaatgagctaaaacatggaacaatcactgaataatttaaaaagagtttacctggcagagtgtgtcatgcctgcaatcccagcactttgggaggccaaggcaggcagatcacctgaggtcaggagtttgagaccagcctggccaacatgatgaaacccttgtctctattaaaaacacaaaaattagccagatgtggtggcacatgcctgtaatcccagttagtcgggaggctgaggcaggagaatatggaactcaggaggcggaggctgcagtcaaccaagattgcgccactgcactccagccagggcgaaggagtgagactcccatctcaaaaaataaaaaaaaaaataaataaaaatagttgacccgggtgggcattccaaaatgttcccatagatgatcgtgaaacaatcactgtgcaaaatgtagaggaaaattcttacgataatcacaaaatttgtatcagaaaaacattacaaatttactttgctccatgtaattttatgaattggcagtattttcttaaattgggatacagtaagagaatatctttaggaaatggaaatgttaaaacaagaagtaacaagaggttgtttttctgaagggaaatgccaccggcctgctttcataggcattgataaagccaggaaggaaataaagtcacaaccgaatagtatacactgtatctactgaattcttctaattccttcacaacagaagtctaaatcctgcttagcctaaacatatctatagccagcgatgggcaaattatatttgctgtcagcatgatggaataagaaacagaaaccccccagcagtggggtaagattgcacgcttcatcccctcaaaatgcagttcagccccactccctctccatgcccatcaaacaactgcaaaatcacttgttactgaatttctcattcagcgttttgtttctttctgtccatacttaaagaccaaattatttgtttgctttgaagaaaaagcaaaagcaacaaaaacaccaaatcatttgaaatccaaccttaacccaattaaaaaaaaattccaccagtggaactaaacagttgagtggtttgggatgtgttgttcgccatttctgtgtttgacctacatggtctctagttctttggacaattgtaactgtgaaactatggcttaacactgttaaagactccaaggctccactctgtagccaggtgcaactcaggctgcacaaataccccaccagaatgtcacaatcattcattgctccagctgctgagtgaacagagtgcaagacagcactggcttgggttttatttttgcagccagttaactttgcatcaggtctacacagtccttgcagcctttgatttctccagttgtacagatttgaaatggggtgcccgggttcctctcgtttttccttcaatctacctagcatgcattttacacacattggaggagtcgatgcactgtttttctcttgctgatggaggcaagaacgccttctaattagtataacttaaatggacgggattgacttaaaagcaagaagaaaagcacatgaacaggtgtcttaatgcatttggatactttggggtgtgtgcctgtctgtgtgtgtgtcttggtgaaggtgggctgtattttcaccaagccttttcataatcaagtttgctttgcaaaccatctggccttgcccccagcagtacagtccttcctaataacggggatgctctgtcatgtttctctgtaaattgttgtgtgttgggaagttctgttgaggcttagtttgatcttccatggtggacatgtctgttctgtatataaaaagcattacatctgtgttttagcaggtgggatttgaagcttttccacagtccttgtgctctgagatggctgttgagctctgctcagctgtcacagctgaattctttttttgtgctgaacactgggcagcctcaccttgttgccaacgtgcttctggggcccctgtgactgctgccggatgctgtgcacacaggcagagtgccttggcaggtttgtgcaccccttggcgagccagaactgggaaccccgcggagtgaccccaccttctcatggggggtcagggaggggagtgcctatttttaatcttgtttgttgcgcaatggaaatcactgtgatttgtacatatgccctaggaaaattttaccgctgtctaatttatgtaataatactgatgattctaggtttgtttaataaaactttatatcttttcagaagcaaggctccactctgtagccaggtgcaactcaggctgca

SEQ ID NO: 322703 - DNA, 6472 bp, Homo sapiens
ttatagagtcttgattaatcaaaatgagctaaaacatggaacaatcactgagtaatttaaaaagagtttaccttccaaagtgttgggattacaggtgtgagccaacgcaccaggtcttgaataacatttttgaacgtttcccagaaaggacttggaccctctgtggaacacccgagtacctagcccccgaagtcattcagagcaagggccacggaagggccgtggactggtgggccctcggcatcctgatattcgagatgctttcggggtttcctccattttttgatgacaacccgtttggcatttatcagaaaattcttgcaggcaaactatatttccccagacatttggatttccatgtaaaaacggggcgaatgatgtgaaacaccatcggtggttccgctccgtggactggaaagctgttccgcagagaaaactgaagcctcccatcgtgcccacgatagctggcaacggcgacacttccaacttcgaaacttaccctgagcatgactgggacacagccgcgcccgtgccgcagaaggatttagaaatcttcaagaatttctgaggacgagctcacatctggaagaaacaggaagattggaatctgcctggaacaaagaactgcacctaagcagaccagaagcaaaatgtcttcttcacggcctgaggacatttccagttttctctgtacctgtgtgtatagaaatagatcagagcacagttgaaattcatggaactggcattatttaagcaaccagaattccacactgtaggaaggttttgaaaattgtttcgttatagattttatcttatcttttggtgttgtcttggtttttctcatagactttataagtttgaactggacttatttgattataaccacaaattgtgtgtgtgtgtgtgtgtgtatatatagaagtcattatggcagatgcacaaattgtgcagtgatgtaaatatacatacttcacagagcctattatttttatttttcaattcagtttctcaaattatcttcccttctcttggggacaacatctgaagggtatgttgcatgcatttttaaaaaaatcatctcatatgcattgtatagtttgggggaataagatatccgggggccgggggtgtctacattcagtatctttagttcttcctacctagtaacttgagactttaaaagaagaaacatggagaagatgtgggagcgaatttattgcaggaatccacaatgactttgaagttgttggagcaatgcattgtattcagaaaacctgtgtcacattaaaaaatttcatctaggctaggtgcagtggcttgttcctgtagtcccagcactctgggaacctgggttgggaggattgcttaaggccaggagtttgagaccagcttgggcaacatagtgaaccctgtctgtatggaatttacacaaattataaaaattagtcgggtgtcattgtgcatacctgtagtcccagctattcaggagctgttgtaggagagattgcctgagctcaagaggttgaggctgcagtgagccctgattgtgccagtgcactccaggctggacgacagagcaagaccctgtattaaaaaaaaaattcatcctgcacagggaaatggctacctattaaagtcccagttgaaattttttgaaaaaatacacctcccacagttcacaaataacttttaagatcagctcatctataaggctgaccttcatgcagagattttatttcacctttagttttgggaaaagcgagaaacagatgatctataggatgtgagtgggtggcagagtcaaaaggaacctcacctgttcctaatttctccttttaaatattcatgttgagtgtgcctaatactctcctcgacaagtcatgctgttttatgcagaataatccaggcgtgagagtgttctcttgggaaatgactggggagacacctgaaaggagcaacccccagatgttcttccctgggtgttgatggcatgacagccatacagtgagtttgttctgaaacatctcttgctaaatgtgggtcatgctagacacagcataaactgagggtgtggggtctggctttgtacataactcattttctcccttgctttttctctggaccatcctggctggaaacttggctgtagacatctgaagagggtgcaccttttctctttactgtgactcacctcaaatatggcattgctcaaatctgctgtgtatgaggtcacagggcccagctgtggcaggggtgagtgcattgaagaagtaggttttggagccttccaggaattccttgttgacaacaggggtacactcacacagacctccaagactttcttctccacctcttctttttctcatgccctgccttcatctgtctccttctgcacccagagtaggggtggagtatacccttgccatgtgttagtgaaaatgtgtgcagtgagaagccagttgggtcccctcggctcctaatctcttctcaaaactcagtagctcaggttctctggagccatccggtgcattccttgctattggagctgtttttccaagcaatatctgggaagagatttctccctctagcacttgctacctctcttctgcacacatatcacacatcagtactgtggagagtttctgttaggaaaagccatacatttttaaaaatgtagcaaaatgtcaagggaaatgtaatcagatttggccagagttcgcctacagataagaaggcactgggccaggctcacacctgtaatcctaagtaacactttgggaggctggggcgagaggattgcttgagcccaggagttcaatacctgtctgggaaacacctcatctctacaaaatacaaaaaagttaactgggcatggtggagcatgcctgtagtctcagctactcaggaggctgagatgagaggatcacttgagcctgaggaggtccaggccacagtgatctgagatcacaccattgccctccagcctgggtgacagagtgagaccctgttccaaaaaaaaaaaaaaacccaaaaaacctcaatggctttttgcttttgaaggtggtatgaagagaacgtccactttaaggctttaaaagacagtgaagctggttgtagggctcacttttataatcctaggatttggggaagctgaagcagaaagattgcttgagcctgggagtttgagactggcctgggcagcatagcgagaccccatctctatataaaaaaaaagatgttaaaacagtgaaattacagaaacagaacatagccaccctgtttcatcagtgaccttttcttcacgtgacggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttactgtgaatgtgaaaaggtgaaactgttgctgacttcggtagcaggtatactaaaattggaatgacacagaggagattagcatggccccctgcgcgaggaagatccgcagattcatgcagcattccatatttttttaaaaaaaggttacactgtgcaccgacgtggagctagaaggaaaagcatgaagtctcatgtttgctgactataaaaataaatcatagtaataatattattgaacattctactttaaaaattattaataaaaccataaatgaaacacttgagcacactttaaaaagtacataaacccatgagtccatatgtgtaattttatgttgtctgttttattatccaggatttcatactcagatgagcattagcatcaggaaagcctgaaatgccttaattgtgaactgatacgcaggaaaatgaaatatgtaagcacattggtgaccttgttctttacagacatcatgatcagcctccagccatacagaacaaatgagaaattagaagcaattccaagaacgtgtgatggtgtgaacccacttttgaccgtcacacacatttcagcatttgaagagacacaggctacctggaaactgcccatggcggggtcataatttaaatgtcccaatgtcatatagaggttaatttaatcaaaatgagctaaaacatggaacaatcactgaataatttaaaaagagtttacctggcagagtgtgtcatgcctgcaatcccagcactttgggaggccaaggcaggcagatcacctgaggtcaggagtttgagaccagcctggccaacatgatgaaacccttgtctctattaaaaacacaaaaattagccagatgtggtggcacatgcctgtaatcccagttagtcgggaggctgaggcaggagaatatggaactcaggaggcggaggctgcagtcaaccaagattgcgccactgcactccagccagggcgaaggagtgagactcccatctcaaaaaataaaaaaaaaaataaataaaaatagttgacccgggtgggcattccaaaatgttcccatagatgatcgtgaaacaatcactgtgcaaaatgtagaggaaaattcttacgataatcacaaaatttgtatcagaaaaacattacaaatttactttgctccatgtaattttatgaattggcagtattttcttaaattgggatacagtaagagaatatctttaggaaatggaaatgttaaaacaagaagtaacaagaggttgtttttctgaagggaaatgccaccggcctgctttcataggcattgataaagccaggaaggaaataaagtcacaaccgaatagtatacactgtatctactgaattcttctaattccttcacaacagaagtctaaatcctgcttagcctaaacatatctatagccagcgatgggcaaattatatttgctgtcagcatgatggaataagaaacagaaaccccccagcagtggggtaagattgcacgcttcatcccctcaaaatgcagttcagccccactccctctccatgcccatcaaacaactgcaaaatcacttgttactgaatttctcattcagcgttttgtttctttctgtccatacttaaagaccaaattatttgtttgctttgaagaaaaagcaaaagcaacaaaaacaccaaatcatttgaaatccaaccttaacccaattaaaaaaaaattccaccagtggaactaaacagttgagtggtttgggatgtgttgttcgccatttctgtgtttgacctacatggtctctagttctttggacaattgtaactgtgaaactatggcttaacactgttaaagactccaaggctccactctgtagccaggtgcaactcaggctgcacaaataccccaccagaatgtcacaatcattcattgctccagctgctgagtgaacagagtgcaagacagcactggcttgggttttatttttgcagccagttaactttgcatcaggtctacacagtccttgcagcctttgatttctccagttgtacagatttgaaatggggtgcccgggttcctctcgtttttccttcaatctacctagcatgcattttacacacattggaggagtcgatgcactgtttttctcttgctgatggaggcaagaacgccttctaattagtataacttaaatggacgggattgacttaaaagcaagaagaaaagcacatgaacaggtgtcttaatgcatttggatactttggggtgtgtgcctgtctgtgtgtgtgtcttggtgaaggtgggctgtattttcaccaagccttttcataatcaagtttgctttgcaaaccatctggccttgcccccagcagtacagtccttcctaataacggggatgctctgtcatgtttctctgtaaattgttgtgtgttgggaagttctgttgaggcttagtttgatcttccatggtggacatgtctgttctgtatataaaaagcattacatctgtgttttagcaggtgggatttgaagcttttccacagtccttgtgctctgagatggctgttgagctctgctcagctgtcacagctgaattctttttttgtgctgaacactgggcagcctcaccttgttgccaacgtgcttctggggcccctgtgactgctgccggatgctgtgcacacaggcagagtgccttggcaggtttgtgcaccccttggcgagccagaactgggaaccccgcggagtgaccccaccttctcatggggggtcagggaggggagtgcctatttttaatcttgtttgttgcgcaatggaaatcactgtgatttgtacatatgccctaggaaaattttaccgctgtctaatttatgtaataatactgatgattctaggtttgtttaataaaactttatatcttttcagaagcaaggctccactctgtagccaggtgcaactcaggctgca

SEQ ID NO: 322704 - DNA, 418 bp, Homo sapiens
  misc_feature (40)..(40): n is a, c, g, or t
gaattccccccccccccccccccccttattattcacttgngggcgagaagtccgagctagggatcctgaaaaggagggaacaattgttgtagcaggtctaaaagttcaggtccaggaaatggaaacattgctttgcttttcctgaattgtccagtgacctatcccaggccttcctttccagtgaacaatggaccatgcaggtggaccctcctcttcacgggcctccaaatgactttctcatttttcaaatcattcctctgcactcactttctataatggtagagaaatgcatatcctggagtctaaagttaaaactttgttttattgagattaatgtttaggtagaatcacatcatccatcttctccaatcttctccaaagacctcagttttaaaatatgacaggattagagatgacc

SEQ ID NO: 322705 - DNA, 390 bp, Homo sapiens
caagggccctttacattgcgttcttaacggttcagtcaccttaaccgttattattcacttgcgggcgagaagtccgagctagggatcctgaaaaggagggaacaattgttgtagcaggtctaaaagttcaggtccaggaaatggaaacattgctttgcttttcctgaattgtccagtgacctatcccaggccttcctttccagtgaacaatggaccatgcaggtggaccctcctcttcacgggcctccaaatgactttctcatttttcaaatcattcctctgcactcactttctataatgccccggtttctctggattctgtgcttctccatggaggaaactcaaggagaactgacaagttcttgtggttctaaaaccatggccaatgta

SEQ ID NO: 322706 - DNA, 135 bp, Homo sapiens
ctggtctggatttgctgggggaagaagaggtccctcagtgaactctcttgttgtctgccacccctcaaacctaagatgctaagaggcaaacagcagtgacaagctccttgtgctagattgtatcatgtcaagtag

SEQ ID NO: 322707 - DNA, 571 bp, Homo sapiens
ttcttctgatcagagaagagccaagacatagataattgaaaatagtaattaacctcaaaccacgtgtatttggctttaaagttagtttcatgattttgagaaacagctgtactttttaaattagatatattcagaaaatcattaatatagctttattccttaagcttataacaaattttatcaaggggcttcaggcgagaattgtgagaagaggctagaatgatccactgagaatgctttcaatcaactgttttattctgtagtcttgcaattaaacactacattctgtacccacactagcatctctatgaagtttcagtgtgttttcaataagcctttctgcaattgaggcataaaacatatcccagtattgtttctggctttggtttatatttggaataagatattaaatgtccagagcaaaacctatagccatctgcgtaaaatgaatgtttatactttacttctctgaggtcactttttctctcactctctattcccaaaagatcatgattcactatattgagatgcctagaattatcaggtcagagtgcttaatttgcaaagattt

SEQ ID NO: 322708 - DNA, 154 bp, Homo sapiens
agtgagatatgactgtgccactgcactgcagactgggtgacatagtgagactctgtccctataaaaataaaaataaataataaaacaatagagagttctgaaataggaacacatatatatagtcaactgacttttaacaagagcaccacattac

SEQ ID NO: 322709 - DNA, 518 bp, Homo sapiens
ccaacacctatcctcaacgtggcagccagaatgattctgttaaagcctaaaattatgtcactcttcagctcaaaatttccaaaggcgcctcatctctgagtaaagaccaaagtcgaagccctatatgtttgggctccccgtttcctctactcgtctctagccaagccctcctggctgttccttgaccataccagctatgtcatgccctcagggttttggtactggctgcaccctctacctggagcatcttctctcagatgcctgcatgtgtgctttctcacgtctttctctactcccatcaaagtagtttcctgctatattttccggtacaccattttcaccttctaatatactatataatttatatacatatggcttttctgctcccttctgcccccatatagaatgtagattccaggaaggcaggaatttggattatttaatttatatactatatcccccacatctggaacagtacatttgaaaaatgaaaagcaaatgtttctctgatggataaa

SEQ ID NO: 322710 - DNA, 297 bp, Homo sapiens
gcaaacagggaatctaaatttgcttcatcttacaccaaacccacatacttcactaaaatcaaaattctgtttaaacacacacacacacagacacacacacacacacacgaatcatggatgggataagttgtaggaaacagtaatccattcgcttattctccatccttttcccgccctttcctccagaccagtttaccagtttaaaaggaacaaagaactagaaaggccaagtgatttttttttttttttttgtaagacaagagtctccctctgtcgcctagcctggagtgcagtggc

SEQ ID NO: 322711 - DNA, 237 bp, Homo sapiens
ttaaaatagaactgttgcctgaacacatagtccccttttgtggatcaaaattacacagcctaccaccaaaaagtgctgtgtgaaatggcgggaatttttttcccagcacttttgaatccaatacagaactagctgccagggaacttggtatattagctcagtttaaaatggcagcttaacaaattcaaaactttctttttaattaaaaaaaaatgccccaacttatgtcttgcaatg

SEQ ID NO: 322712 - DNA, 296 bp, Homo sapiens
tgtcattaacaccctgaacacattaacactgtttactttaaataaaatcccttaatagcctaagagactgaacctattttgatggctgagaatgaagaggtcatgagaaggttcaaaacagaagttcagaagtggatctgcagttggttacgaggcaccagacgggcgggttgatggttattttctctcagctttttgaagaccagattctgctctctcctggccactgtcgtcgtgttgagaagtctgctgccactgtaaatgccactgtggaggacatcattctttcctccagc

SEQ ID NO: 322713 - DNA, 745 bp, Homo sapiens
aaactccaaacacatccgaacatcagaaggaacaaactccagatgcgccaccttaagagctgtaacactcaccgcgagggtccccagcttcgtttttgaagtcagtgagaccaagaacccaccaattctggacacattaccatttaactttcttctcattgtcataatattggaactgcgcctagattctcaaaatgttcatcttgtctgcaatcacttcaacagaagcttatattaaatatcaggtcatgcctcataaatacccccaaattttgagaacaaaaagcactgtatctttctattgtcacagaacttcctccagccttgatctgagaaccccaattaggctattcaataggttggctatattgggaaaggtaattgtaagaataaaatattcttaaaataagaagaataaaatattcaagaataaatttatcaaaagttgtttcaaacttctacacttaatacaaatttgctgaaagaaagtaaagacaattgaaacaaaaggagaaatatactagatttatgggctgaaagataatatttttaagatgtcaattctcctcaaatgtatcaatatatttaatgcaattccaaccaaaattccagaaggcatgacaagctgattcaaatagtatagtgctaaaatgtgatgtagtgtagagtagtggttaatattcagattctagactcagatgcttggctctaccattttctatctgtatgtatgacctttatccaa

SEQ ID NO: 322714 - DNA, 493 bp, Homo sapiens
tctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagc

SEQ ID NO: 322715 - DNA, 528 bp, Homo sapiens
tggttaatataaacatttgtttattcattccacaaatattgattgaccatgaaggatgtaccagacacagttctaggctcttgggaaaaagtagagaacaaggctgacagaggtccctgctcccctagagcttacattttagccagaggcggatgatgaaaaaggaaacaatgtaattcacaaggcctgtaaattccaccagggtagagaaggtgttgcatttgtaccttgatctatcccaagtgcataagacagggcatacgagcaggcactcaatgaatgtgctgaatgactggaaggagattatttcagatagtgctgtgtgcaagaaggcaaggaaacggcccgacatgacagagcgggaaggtcggcttggctagatgcgatgtactcctgagaaagccctgctgagctaaagcagatggtgtgaaggaaccaatcatgggacagtctttgggacggctattccaggccaaagaagattccgtgcctaagctgaaggccccaaggcaaggctgtgctggacct

SEQ ID NO: 322716 - DNA, 112 bp, Homo sapiens
gattaatataaaatacatttggtgtagctcactgcagattatgcatactacatacttttatgtgaaattggcagaaatcatcagcattaaagcccttataaagttcattttc

SEQ ID NO: 322717 - DNA, 190 bp, Homo sapiens
ctgagatgtgactcatctatttttggcataagggtatattttgataacatctaatacatgaaaaacagaattataagtgaaattggagaatgattaccttttttaaatgcttggttttttcaaaataatgtacagtaggctctgcatggtcaacttcctacagatttgctttttggaatttcagttagca

SEQ ID NO: 322718 - DNA, 265 bp, Homo sapiens
agatcatacagtcccacctcctaccaaatgcagtcacccaaaatcaatgacattccacctctgctacaatggtagcataggaagtgttactttgcaaagtgactaattctgttgttcatcagtttggcccagtgtttctcaaatttttcttaccaaaacccacagtaagaaatacattttggctgggtgcagtggctcatgcctgtaatcccaacactttgggaagccaaggtgagttgattgcttgagctcaggagtttgagac

SEQ ID NO: 322719 - DNA, 658 bp, Homo sapiens
ctggcactgtgttctcttgggaaggaggctccccagagcccatctgctctcagaacttggtcctagagaggaggctccctccctggctgtgtctagaggatggaaccgggatctggggtttagtcacagccatctctctccttttggcacagttggtcgtgatctcccagcactccacttgtgtcctttgtctgcagggtcgtgctctcattccccctagaatggggctccctccctcaggaaccttgccgggacactccagggtttctgtggggaggctgtcaggttctcagcctcccctctgccctgaggtctcctgtctgtcaggtgtcagggtgtgccatcccccacatggctgcagagaggatgctcagacaggcctgcagccaccctgcacccatgggggaatttaaactccattcctgagtcatcctggccttgggagcaagacgagtgggctcagccctggcccacaccaaggcagcagcttcccatctctaaaacgggagaaatgctccctgccatccctcgatccctggggcccattaggtaaagatggccagttgcagttaggtttggtttccttaaaaggaatgtgaggttgccaggcattgctctctctgagagaaggttcattctgagctctcggccagctggg

SEQ ID NO: 322720 - DNA, 423 bp, Homo sapiens
acttgagcatcagtggatcttggtatctgcagggaatcctgggatgaatcccccatggatactgaaggaaaactgtacatatatgtgtgtatatataatgtatgtatgtgtatatatatgtgtattatacataaatatatgtgtgtgtgtgtgtgtgtgtgtgtgtatacacacacatatatggaatgtgtatgtctaaaacaaaacaacctagggcttgaagaaggtagctttcagtaaatgatggccgcatggtatatttatttttttttaagtggttgaatttcattgtattgcagagcaagggagatttgctccttacctttctctctccttgcctttttttcatctttctttctctctctctctctctttttttttttttgctctgtcgccaggctggagtgcagtggcgcaatctcc

SEQ ID NO: 322721 - DNA, 911 bp, Homo sapiens
tagccggattcggcataacggcggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaagaaaaaaaaacacaaaaacaaaaaaaacccgggggcttctatgcgggggggggaaaaa

SEQ ID NO: 322722 - DNA, 1135 bp, Homo sapiens
aaactgatgaagaaagtatttggcaaagttcttcaaagccaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaacacaaaaacacagggcgggcagacaaaaatacccccgggggggcacaagagaacagcgacacagagtatgtggcacagggggcccataagacgagaggcgcaaaaaacagaccgacaggccgagcgaaaaaaactgcgagggacaacagcatcgggaatagagaagccccactcggcgtcatctcggagcacaagagatcacagcggaacatattatgagataagccaccctgcgagacgtagaacgaaagcaacagaaaagcgacaaagaagaaacaacagagg

SEQ ID NO: 322723 - DNA, 979 bp, Homo sapiens
ggctaggtacgaggcgggtgtgtgaatcggccgaggagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaagcccggttgaaaaaaaacaacaaagggggcgcaaatccgggggcattagcggccgtttggaagggcgagggggaaaaagggggggaaccggaggaaaggggtgggccctggggatggacccaaccgaaaatgggggggtgaaaaaagatg

SEQ ID NO: 322724 - DNA, 859 bp, Homo sapiens
ttcagcaggacgaggccgggtgtcaatcggccgaggctggaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaagtgtctaccatgattattttttaacgctgcttggtaataacaactgttcactccgctccacctgcctct

SEQ ID NO: 322725 - DNA, 639 bp, Homo sapiens
tctagagtatacccctgccgaaagcgtagtacccaaattggtgttagtacatcagaatcatgaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggccaaagcgtagtacccaactcctctctactcttatccttttatcctctgtctctgcttatcacctctcttgcgtatttctggatctccttccctcctttctcgtccaaatcatgaaatgtttggccttagtcaatgtctatgcccgtcacataacagccgaggcaccgaggcccacagggaagcagctgggagcttggaaacctggtctcttgaatttcaaacctggtttcttacaggtggttgtctggggtgggtggagtggcgacaggatagagctgaaggactatgcaaatgaggaagtaagtcagggcgggctttgagaaggggacccatatcctacaggcaaaaagcaggctaggtgaccttgggtactacgctttggca

SEQ ID NO: 322726 - DNA, 1020 bp, Homo sapiens
tagccggattcggcataacggcggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaagaaaacaaaaaatttaaaaaaaaagggggggtccatttggggggggggggagaaaaaagggtttaaaaaggggcaggggtaaaacgggtgttcgggacccctttttttgtcaaagggggaaatggggggcccaaaaaggagggggaaaaattgagaaacgggacgag

SEQ ID NO: 322727 - DNA, 1138 bp, Homo sapiens
tagccggattcggcataacggcggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaacacaaaaacacagggcgggcagacaaaaatacccccgggggggcacaagagaacagcgacacagagtatgtggcacagggggcccataagacgagaggcgcaaaaaacagaccgacaggccgagcgaaaaaaactgcgagggacaacagcatcgggaatagagaagccccactcggcgtcatctcggagcacaagagatcacagcggaacatattatgagataagccaccctgcgagacgtagaacgaaagcaacagaaaagcgacaaagaagaaacaacagagg

SEQ ID NO: 322728 - DNA, 1388 bp, Homo sapiens
  misc_feature (15)..(15): n is a, c, g, or t
  misc_feature (54)..(54): n is a, c, g, or t
  misc_feature (74)..(74): n is a, c, g, or t
ggtcgcccttgcaancccattggctaaccgctgcattacatccgaaagtgactngcgccatttgtgggaaaccngccaattcggccattatggccgggggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322729 - DNA, 2538 bp, Homo sapiens
  misc_feature (1238)..(1238): n is a, c, g, or t
tgggggaggagccccgcagcctccacctacaggggcgtcccctaaggggacggaggccgcatgggccgccgagccgggaaatctccgcccccagctggagcggctgtgcgggctgcgtagcggtgctgggtcgggccgacgtgccacccacccggagccgggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcatggaaccttgccgttggggaacctgacgtctaagtgtccacatcactcgagacgtanattatggctgaatcatccgctaccttcacgagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322730 - DNA, 2700 bp, Homo sapiens
  misc_feature (1400)..(1400): n is a, c, g, or t
tgggggaggagccccgcagcctccacctacaggggcgtcccctaaggggacggaggccgcatgggccgccgagccgggaaatctccgcccccagctggagcggctgtgcgggctgcgtagcggtgctgggtcgggccgacgtgccacccacccggagccggctgttgcagaggcggcttgcttcccacctgtccatctccataaaaatccctaaacgaaacatgcccacgtgtccggagattttcaggacttggtgcatttcagatgaaggcttttccagaagcttccccgtagaagaggatcaggcatccaactggttaagggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcatggaaccttgccgttggggaacctgacgtctaagtgtccacatcactcgagacgtanattatggctgaatcatccgctaccttcacgagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322731 - DNA, 2199 bp, Homo sapiens
ttcagcggatcaggtccgtccgtgaggcctccttgtaggtgctgttgtccaggatgctctggaaggtcaagccatgctccggagcatactgttccttgagtggaccagagagccggaggacagcacagacatcagctccaagtctgctctgcagcgcctcggtcacgaagtccgtcccggatgtcctcttgccgctgaacagcagtaccagccgcggggcagcctcccagcggggccatgggctcgccacgcctcgcgatgcctgaagctgacacttctccctacccctaaaatcgggacaccgcgcggaatggacgcggccactaagcggagcgacgacaaggacctcgcggagcggcgaaaggggtgtagtctgcgactaccgcggcagggagccgggagggcggccaaaagtgacttcgaattgcagctagccgtttggaacgtggcccaagaggctctcattttcctggctggaaccgtcgccgcggtgcttgcctgcggtcctggtcagccgttgccctcccgccgggcgggcgaagactggtgcatgctgggatttgtagttcgtccccatgaggctcgtcctgggaacattatggggaggaacggagcctaatcctgtcagcgcagcctggggattaggacccggagttgccaaggtgtcagcactctttgctcttgaattgattaaaaagtctaatcaaatgcatatattttcttcaaacaagttttacccgaaagtttgttgaaagaggctaaatcagggagttctttgcgtctgcaaggcggctttttagttctggattcttttccggcttattctaagacacctatgagtcgtggggcttctctcgcgaagtctttaagtggacagtacgcatgcgccaacggcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322732 - DNA, 931 bp, Homo sapiens
  misc_feature (845)..(845): n is a, c, g, or t
tagccggattcggcataacggcggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaagtctaccatgataattttctaagctggtggtaataacaggtactgcctctcnaattggaaaaaaaaaaaacccgggcatttgcgggggaaagtttaagggcagcataggtctgcctttaaaagaatggaccaagaaga

SEQ ID NO: 322733 - DNA, 1190 bp, Homo sapiens
tagccggattcggcataacggcggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgagagacctcatcctgagaaaggttgagttaatgttagagtataagtggtggtaatcttgaatacttttcccattaaatattgatgggggtttgaattttaatcagtgcttttgtggggagtgggggtcaactatcttaatgattacagttggtttgtttactgcttttgaggacctttctggaggaaaggaaaagcctgttttggggagtctttaaagatggaaattgggtggtcttaaaaatgtaaactcaatcattactttataactgcctagtttatgttaattgttagctgcctaaagtgttttctaatggttttcttttttcctttcaggtgtctaccatgattatttttctaagctggttggttaataaacagtacctgctctcaaa

SEQ ID NO: 322734 - DNA, 1327 bp, Homo sapiens
aaactgatgaagaaagtatttggcaaagttcttcaaagccaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322735 - DNA, 1327 bp, Homo sapiens
ttcagcaggacgaggccgggtgtcaatcggccgaggctggaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322736 - DNA, 1306 bp, Homo sapiens
ggctaggtacgaggcgggtgtgtgaatcggccgaggagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322737 - DNA, 1348 bp, Homo sapiens
ccgggggtttttttatataaaaagcgtggtacggcgatctggattgtcgacagcgtcgcatgagggtgtagagaaagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322738 - DNA, 2061 bp, Homo sapiens
  misc_feature (1238)..(1238): n is a, c, g, or t
tgggggaggagccccgcagcctccacctacaggggcgtcccctaaggggacggaggccgcatgggccgccgagccgggaaatctccgcccccagctggagcggctgtgcgggctgcgtagcggtgctgggtcgggccgacgtgccacccacccggagccgggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcatggaaccttgccgttggggaacctgacgtctaagtgtccacatcactcgagacgtanattatggctgaatcatccgctaccttcacgagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaa

SEQ ID NO: 322739 - DNA, 1274 bp, Homo sapiens
gtgctgggtgatctagaggatccgagagagagaaggggaggtctgtgtgcagaaccttagaaaaggaaggattcgagagtgagatcagcgctgagaagagttgccaaaagttgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322740 - DNA, 1324 bp, Homo sapiens
  misc_feature (39)..(39): n is a, c, g, or t
cttgacttacgtgtaaaagcagctggtcgctcggatatntccccccccggggggatatcgtcgacacctcgactgaggtgagagagagagagtctgcttgcgaactagaaagcgagattcgcaagcgagatcaagcgcctgagaagaaattgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322741 - DNA, 1778 bp, Homo sapiens
  misc_feature (1692)..(1692): n is a, c, g, or t
  misc_feature (1694)..(1697): n is a, c, g, or t
  misc_feature (1700)..(1700): n is a, c, g, or t
  misc_feature (1706)..(1706): n is a, c, g, or t
  misc_feature (1708)..(1708): n is a, c, g, or t
  misc_feature (1711)..(1711): n is a, c, g, or t
  misc_feature (1718)..(1718): n is a, c, g, or t
  misc_feature (1723)..(1723): n is a, c, g, or t
ttcagcggatcaggtccgtccgtgaggcctccttgtaggtgctgttgtccaggatgctctggaaggtcaagccatgctccggagcatactgttccttgagtggaccagagagccggaggacagcacagacatcagctccaagtctgctctgcagcgcctcggtcacgaagtccgtcccggatgtcctcttgccgctgaacagcagtaccagccgcggggcagcctcccagcggggccatgggctcgccacgcctcgcgatgcctgaagctgacacttctccctacccctaaaatcgggacaccgcgcggaatggacgcggccactaagcggagcgacgacaaggacctcgcggagcggcgaaaggggtgtagtctgcgactaccgcggcagggagccgggagggcggccaaaagtgacttcgaattgcagctagccgtttggaacgtggcccaagaggctctcattttcctggctggaaccgtcgccgcggtgcttgcctgcggtcctggtcagccgttgccctcccgccgggcgggcgaagactggtgcatgctgggatttgtagttcgtccccatgaggctcgtcctgggaacattatggggaggaacggagcctaatcctgtcagcgcagcctggggattaggacccggagttgccaaggtgtcagcactctttgctcttgaattgattaaaaagtctaatcaaatgcatatattttcttcaaacaagttttacccgaaagtttgttgaaagaggctaaatcagggagttctttgcgtctgcaaggcggctttttagttctggattcttttccggcttattctaagacacctatgagtcgtggggcttctctcgcgaagtctttaagtggacagtacgcatgcgccaacggcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttttgagatgactagggtctccgattttttctaccggggggtataaacgncnnnntcnatggananaanacaaaanaaaantgggggccccaaatttaaatcgggcgcgcccaagaaaagaagtcagacgagaaag

SEQ ID NO: 322742 - DNA, 1673 bp, Homo sapiens
ttcagcggatcaggtccgtccgtgaggcctccttgtaggtgctgttgtccaggatgctctggaaggtcaagccatgctccggagcatactgttccttgagtggaccagagagccggaggacagcacagacatcagctccaagtctgctctgcagcgcctcggtcacgaagtccgtcccggatgtcctcttgccgctgaacagcagtaccagccgcggggcagcctcccagcggggccatgggctcgccacgcctcgcgatgcctgaagctgacacttctccctacccctaaaatcgggacaccgcgcggaatggacgcggccactaagcggagcgacgacaaggacctcgcggagcggcgaaaggggtgtagtctgcgactaccgcggcagggagccgggagggcggccaaaagtgacttcgaattgcagctagccgtttggaacgtggcccaagaggctctcattttcctggctggaaccgtcgccgcggtgcttgcctgcggtcctggtcagccgttgccctcccgccgggcgggcgaagactggtgcatgctgggatttgtagttcgtccccatgaggctcgtcctgggaacattatggggaggaacggagcctaatcctgtcagcgcagcctggggattaggacccggagttgccaaggtgtcagcactctttgctcttgaattgattaaaaagtctaatcaaatgcatatattttcttcaaacaagttttacccgaaagtttgttgaaagaggctaaatcagggagttctttgcgtctgcaaggcggctttttagttctggattcttttccggcttattctaagacacctatgagtcgtggggcttctctcgcgaagtctttaagtggacagtacgcatgcgccaacggcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggccacggggggcacaatcaacgggttttatgcgggggtcccagattattttctggggg

SEQ ID NO: 322743 - DNA, 1836 bp, Homo sapiens
  misc_feature (1238)..(1238): n is a, c, g, or t
tgggggaggagccccgcagcctccacctacaggggcgtcccctaaggggacggaggccgcatgggccgccgagccgggaaatctccgcccccagctggagcggctgtgcgggctgcgtagcggtgctgggtcgggccgacgtgccacccacccggagccgggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcatggaaccttgccgttggggaacctgacgtctaagtgtccacatcactcgagacgtanattatggctgaatcatccgctaccttcacgagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaatacgctcatctgcatggacaagtaccgcagagggtccgac

SEQ ID NO: 322744 - DNA, 1797 bp, Homo sapiens
  misc_feature (1238)..(1238): n is a, c, g, or t
tgggggaggagccccgcagcctccacctacaggggcgtcccctaaggggacggaggccgcatgggccgccgagccgggaaatctccgcccccagctggagcggctgtgcgggctgcgtagcggtgctgggtcgggccgacgtgccacccacccggagccgggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcatggaaccttgccgttggggaacctgacgtctaagtgtccacatcactcgagacgtanattatggctgaatcatccgctaccttcacgagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcgaaatatgttgacagataacgctttgattgctcgatctacatcatccgagatttgattcatct

SEQ ID NO: 322745 - DNA, 2094 bp, Homo sapiens
tgggggaggagccccgcagcctccacctacaggggcgtcccctaaggggacggaggccgcatgggccgccgagccgggaaatctccgcccccagctggagcggctgtgcgggctgcgtagcggtgctgggtcgggccgacgtgccacccacccggagccggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcatggaaccttgccgttggggaacctgacgtctaagtgtccagaaaggaggatgtgggcagggacggggtacagaggatagtgtgggtcagaggtgccagtagtataatattcatctccctggagttatgttgaaggcagagttttcatagggttagattttttttatccttttctagttcagttaattcatcctgttgaattgcaccatcgtgaaagatgggaaaaatcgtgatgatgggtaaggggaaaacttcccggaaggcaatggggcaaggaaaaagaaagcctatgggaaatggctgtgctcccaacatagctttgcagatgatgtgggttttttttttttttttttggttgtttgttttgagagagagtcttgctctgtctccctggctagggtgtggtggtgtgatcttggctcacggcagccttgccctccctggctcaagcagtcttcatctcagcctccagagtagctgggactacaggcatgtgatatgatgctcggctgatttttgtttactttttagagagatggggtcttgccatatttgccaggctggtttgaactcctacaactcaagcattcctcccaccttggtctcccaaaatgttgggaccacgggtgtgagccaccgcgcccagctagctcctgtgttttgtttttgttttgtaactttggttgatgttaaggccctccattttggaaagcaggaaaacaggatttttttttttttatcttgttccctggaggatccagggatgaggatagagtggcctgagagcagtgcttggattcagcctcctgctgggtccttctgctggatacaggcaccaagaggcgggggtggagcagggagctgcgccttcctggggtgcccggtggtgtgtagagaaaagctgcttgtttactccttaagtcaatgtattggtgactgttgatttgttggacaattcaggaatcaagggctgtggagaaactccctcatgttgttggcaacaggtgaatgaacctagagcggtgacatgaaaataaagctcactgttactcgc

SEQ ID NO: 322746 - DNA, 986 bp, Homo sapiens
  misc_feature (101)..(101): n is a, c, g, or t
gagctcggtacccgcgtgggttccatgcaggggtgtgtgtgcgtaggggtgtgtgtgcaggggtgtgtgcgtgggttccttgcagaaccccaattggcgtntgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcgtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322747 - DNA, 1037 bp, Homo sapiens
tagccggattcggcataacggcggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322748 - DNA, 1143 bp, Homo sapiens
ttcagcggatcaggtccgtccgtgaggcctccttgtaggtgctgttgtccaggatgctctggaaggtcaagccatgctccggagcatactgttccttgagtggaccagagagccggaggacagcacagacatcagctccaagtctgctctgcagcgcctcggtcacgaagtccgtcccggatgtcctcttgccgctgaacagcagtaccagccgcggggcagcctcccagcggggccatgggctcgccacgcctcgcgatgcctgaagctgacacttctccctacccctaaaatcgggacaccgcgcggaatggacgcggccactaagcggagcgacgacaaggacctcgcggagcggcgaaaggggtgtagtctgcgactaccgcggcagggagccgggagggcggccaaaagtgacttcgaattgcagctagccgtttggaacgtggcccaagaggctctcattttcctggctggaaccgtcgccgcggtgcttgcctgcggtcctggtcagccgttgccctcccgccgggcgggcgaagactggtgcatgctgggatttgtagttcgtccccatgaggctcgtcctgggaacattatggggaggaacggagcctaatcctgtcagcgcagcctggggattaggacccggagttgccaaggtgtcagcactctttgctcttgaattgattaaaaagtctaatcaaatgcatatattttcttcaaacaagttttacccgaaagtttgttgaaagaggctaaatcagggagttctttgcgtctgcaaggcggctttttagttctggattcttttccggcttattctaagacacctatgagtcgtggggcttctctcgcgaagtctttaagtggacagtacgcatgcgccaacggcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagctgatctatgaaattagaaaagcacccggaacagagtgggcaccccattaagactgctgcagtcagtgaactgccaagtattct

SEQ ID NO: 322749 - DNA, 853 bp, Homo sapiens
tagccggattcggcataacggcggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaa

SEQ ID NO: 322750 - DNA, 2234 bp, Homo sapiens
tgggggaggagccccgcagcctccacctacaggggcgtcccctaaggggacggaggccgcatgggccgccgagccgggaaatctccgcccccagctggagcggctgtgcgggctgcgtagcggtgctgggtcgggccgacgtgccacccacccggagccgggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcatggaaccttgccgttggggaacctgacgtctaagtgtccagaaaggaggatgtgggcagggacggggtacagaggatagtgtgggtcagaggtgccagtagtataatattcatctccctggagttatgttgaaggcagagttttcatagggttagattttttttatccttttctagttcagttaattcatcctgttgaattgcaccatcgtgaaagatgggaaaaatcgtgatgatgggtaaggggaaaacttcccggaaggcaatggggcaaggaaaaagaaagcctatgggaaatggctgtgctcccaacatagctttgcagatgatgtgggttttttttttttttttttggttgtttgttttgagagagagtcttgctctgtctccctggctagggtgtggtggtgtgatcttggctcacggcagccttgccctccctggctcaagcagtcttcatctcagcctccagagtagctgggactacaggcatgtgatatgatgctcggctgatttttgtttactttttagagagatggggtcttgccatatttgccaggctggtttgaactcctacaactcaagcattcctcccaccttggtctcccaaaatgttgggaccacgggtgtgagccaccgcgcccagctagctcctgtgttttgtttttgttttgtaactttggttgatgttaaggccctccattttggaaagcaggaaaacaggatttttttttttttatcttgttccctggaggatccagggatgaggatagagtggcctgagagcagtgcttggattcagcctcctgctgggtccttctgctggatacaggcaccaagaggcgggggtggagcagggagctgcgccttcctggggtgcccggtggtgtgtagagaaaagctgcttgtttactccttaagtcaatgtattggtgactgttgatttgttggacaattcaggaatcaagggctgtggagaaactccctcatgttgttggcaacaggtgaatgaacctagagcggtgacatgaaaataaagctcactgttactcgc

SEQ ID NO: 322751 - DNA, 1330 bp, Homo sapiens
tagccggattcggcataacggcggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322752 - DNA, 1035 bp, Homo sapiens
tagccggattcggcataacggcggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaaggttaaaaacaaaaagaaaaaaaaaaaatgttggggggggggaccaggaaaaagttttaaaacactggtggggcggggcccggtgggtatgtaaatggcatagggttcaaagaaacgggctgagaaggggggttccacaaaaaagccggggacgggttgaaaaacagagggttcggaaaggc

SEQ ID NO: 322753 - DNA, 1003 bp, Homo sapiens
tagccggattcggcataacggcggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaagcccggttgaaaaaaaacaacaaagggggcgcaaatccgggggcattagcggccgtttggaagggcgagggggaaaaagggggggaaccggaggaaaggggtgggccctggggatggacccaaccgaaaatgggggggtgaaaaaagatg

SEQ ID NO: 322754 - DNA, 3083 bp, Homo sapiens
  misc_feature (1783)..(1783): n is a, c, g, or t
tgggggaggagccccgcagcctccacctacaggggcgtcccctaaggggacggaggccgcatgggccgccgagccgggaaatctccgcccccagctggagcggctgtgcgggctgcgtagcggtgctgggtcgggccgacgtgccacccacccggagccggtgagtgcagccgcccgccctccggtagatctgcggcctggcggagaagtcgggaggggacaggaagggaggggcgggccccgggccctcctccgtctcagccgcctgcggaggtgctgcccacgcctggaggcccccactgaccctcagacccgcgtctgcgcccctctccccgcaccccgaggcagagttgggaaagcagtggtcttagaccccccacctcgggcactcggaagagaacggcggagacaacccctcctcttccctggctggcgcagcgccagcctcgagctcctcggtagcccccgggcagggagggccggagggtgggcgcggcatcttcagcgactcttcgaagtcccttccgcgtctcatctttcaaggctgttgcagaggcggcttgcttcccacctgtccatctccataaaaatccctaaacgaaacatgcccacgtgtccggagattttcaggacttggtgcatttcagatgaaggcttttccagaagcttccccgtagaagaggatcaggcatccaactggttaagggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcatggaaccttgccgttggggaacctgacgtctaagtgtccacatcactcgagacgtanattatggctgaatcatccgctaccttcacgagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322755 - DNA, 2398 bp, Homo sapiens
  misc_feature (1098)..(1098): n is a, c, g, or t
tgggggaggagccccgcagcctccacctacaggggcgtcccctaaggggacggaggccgcatgggccgccgagccgggaaatctccgcccccagctggagcggctgtgcgggctgcgtagcggtgctgggtcgggccgacgtgccacccacccggagccggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcatggaaccttgccgttggggaacctgacgtctaagtgtccacatcactcgagacgtanattatggctgaatcatccgctaccttcacgagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322756 - DNA, 2090 bp, Homo sapiens
  misc_feature (790)..(790): n is a, c, g, or t
tggtgaattctcatttaatgctcacaaaaaccaggtaagccatccctgccttacagataaggaaactgcagctaattgaggctgaggagcttgtcagggtcacgtgggtaggatctgcttgagctgcgattcaagtgcaggcagtcagatgcccgatccgtttttgatagcctgtttgccatgacgggccatgcatgagtttcatttcatcttcacagcaaccttaaaggtaggaattgtcaactccattttacagacagagaaatggagtcagagatcgcagacccgtctagggtcccccaggacatggaagagctgatttctgccttgttaactttgtgggtggtttcatcatgccatgtgtcctttgtccttcccttaccttcccccgctttatttcagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcatggaaccttgccgttggggaacctgacgtctaagtgtccacatcactcgagacgtanattatggctgaatcatccgctaccttcacgagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322757 - DNA, 853 bp, Homo sapiens
  misc_feature (807)..(807): n is a, c, g, or t
tagccggattcggcataacggcggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaagttccggtatttcnaaggggggggaaataacagccgggtccatttaaacaacacaacgtc

SEQ ID NO: 322758 - DNA, 862 bp, Homo sapiens
tagccggattcggcataacggcggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaagtgtctaccatgattattttttaacgctgcttggtaataacaactgttcactccgctccacctgcctct

SEQ ID NO: 322759 - DNA, 1843 bp, Homo sapiens
ccctctcacacggccgtggccgcaacctcagccctcctcgcacctcccttcgcagctcacgccccctcccgtggggtgtcctggcctccgcctgccgagctcggcagtcagcagagccccggccatcctcctccggccgtccggtccccactggtccctggctagccacttttcgtaagctagagcactccagaccgccccgcctgcgatcaggcgctgcggaagacagccctgtgggctggagcgacgacaaggacctcgcggagcggcgaaaggggtgtagtctgcgactaccgcggcagggagccgggagggcggccaaaagtgacttcgaattgcagctagccgtttggaacgtggcccaagaggctctcattttcctggctggaaccgtcgccgcggtgcttgcctgcggtcctggtcagccgttgccctcccgccgggcgggcgaagactggtgcatgctgggatttgtagttcgtccccatgaggctcgtcctgggaacattatggggaggaacggagcctaatcctgtcagcgcagcctggggattaggacccggagttgccaagagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322760 - DNA, 1324 bp, Homo sapiens
aattatgtatacgtacgaggcctgggttgttatgtaacattggagggtgtgaatagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322761 - DNA, 909 bp, Homo sapiens
  misc_feature (823)..(823): n is a, c, g, or t
  misc_feature (825)..(828): n is a, c, g, or t
  misc_feature (831)..(831): n is a, c, g, or t
  misc_feature (837)..(837): n is a, c, g, or t
  misc_feature (839)..(839): n is a, c, g, or t
  misc_feature (842)..(842): n is a, c, g, or t
  misc_feature (849)..(849): n is a, c, g, or t
  misc_feature (854)..(854): n is a, c, g, or t
tagccggattcggcataacggcggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttttgagatgactagggtctccgattttttctaccggggggtataaacgncnnnntcnatggananaanacaaaanaaaantgggggccccaaatttaaatcgggcgcgcccaagaaaagaagtcagacgagaaag

SEQ ID NO: 322762 - DNA, 855 bp, Homo sapiens
  misc_feature (752)..(753): n is a, c, g, or t
  misc_feature (757)..(757): n is a, c, g, or t
  misc_feature (763)..(763): n is a, c, g, or t
  misc_feature (765)..(767): n is a, c, g, or t
  misc_feature (781)..(781): n is a, c, g, or t
  misc_feature (785)..(785): n is a, c, g, or t
  misc_feature (789)..(789): n is a, c, g, or t
  misc_feature (791)..(791): n is a, c, g, or t
  misc_feature (798)..(798): n is a, c, g, or t
  misc_feature (801)..(801): n is a, c, g, or t
  misc_feature (806)..(806): n is a, c, g, or t
tagccggattcggcataacggcggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggccggnngacnatcacngnnntagaaatgctaggntccngatntnctagcgnggnaaacngcgcccattgaaaaaaaaaccgggtttgggggggaggggaaggaggaag

SEQ ID NO: 322763 - DNA, 1164 bp, Homo sapiens
ggccggatcgtatagtggttagtactctgcgtggaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322764 - DNA, 1800 bp, Homo sapiens
  misc_feature (1714)..(1714): n is a, c, g, or t
ttcagcggatcaggtccgtccgtgaggcctccttgtaggtgctgttgtccaggatgctctggaaggtcaagccatgctccggagcatactgttccttgagtggaccagagagccggaggacagcacagacatcagctccaagtctgctctgcagcgcctcggtcacgaagtccgtcccggatgtcctcttgccgctgaacagcagtaccagccgcggggcagcctcccagcggggccatgggctcgccacgcctcgcgatgcctgaagctgacacttctccctacccctaaaatcgggacaccgcgcggaatggacgcggccactaagcggagcgacgacaaggacctcgcggagcggcgaaaggggtgtagtctgcgactaccgcggcagggagccgggagggcggccaaaagtgacttcgaattgcagctagccgtttggaacgtggcccaagaggctctcattttcctggctggaaccgtcgccgcggtgcttgcctgcggtcctggtcagccgttgccctcccgccgggcgggcgaagactggtgcatgctgggatttgtagttcgtccccatgaggctcgtcctgggaacattatggggaggaacggagcctaatcctgtcagcgcagcctggggattaggacccggagttgccaaggtgtcagcactctttgctcttgaattgattaaaaagtctaatcaaatgcatatattttcttcaaacaagttttacccgaaagtttgttgaaagaggctaaatcagggagttctttgcgtctgcaaggcggctttttagttctggattcttttccggcttattctaagacacctatgagtcgtggggcttctctcgcgaagtctttaagtggacagtacgcatgcgccaacggcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaagtctaccatgataattttctaagctggtggtaataacaggtactgcctctcnaattggaaaaaaaaaaaacccgggcatttgcgggggaaagtttaagggcagcataggtctgcctttaaaagaatggaccaagaaga

SEQ ID NO: 322765 - DNA, 1379 bp, Homo sapiens
tagccggattcggcataacggcggggctctttttccggctggaaccatggagggtgtagaagagcccaagaacgcggtcctgtctgtgcccacgaacaccctctaaggaaagacgcgactgaatctcgcatagcttgaagatcccgcgcctgctacctgacttctgcccgaatctgtatgcttcgatgacggcatggtaggacgcttatctattgcaaaaggcccagcaacctaagtcatctacatggcatattactaggagcaaaaattggtcacatggaagacgtgatgaattcagagaatgggcggaagggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322766 - DNA, 1217 bp, Homo sapiens
  misc_feature (205)..(205): n is a, c, g, or t
agagcaggtactgtttattaaccaaccagcttagaaaaataatcatggtagacaccttagttcattcttctaataagcctgttgatctggtcctccctgttgccagcatctccaccttctacaaaatgggtggtctttttctatcattccacctcgtggagaagacatttgaagcggccacaggaagttatttgccattggcgtntgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322767 - DNA, 1113 bp, Homo sapiens
  misc_feature (101)..(101): n is a, c, g, or t
gagctcggtacccgcgtgggttccatgcaggggtgtgtgtgcgtaggggtgtgtgtgcaggggtgtgtgcgtgggttccttgcagaaccccaattggcgtntgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322768 - DNA, 2837 bp, Homo sapiens
  misc_feature (1238)..(1238): n is a, c, g, or t
tgggggaggagccccgcagcctccacctacaggggcgtcccctaaggggacggaggccgcatgggccgccgagccgggaaatctccgcccccagctggagcggctgtgcgggctgcgtagcggtgctgggtcgggccgacgtgccacccacccggagccgggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcatggaaccttgccgttggggaacctgacgtctaagtgtccacatcactcgagacgtanattatggctgaatcatccgctaccttcacgagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaggttctatttgggggaaaatttggtattagaccatgcgataatttcttaccctcttgtggccgtacatttctcactattgtgaatcttcatgtgttccctatgattcttgatttagcttaaaagaaaacgtaagacatggtttcattagcttgaaccttatctttgtaaagccatgcatttaccttgtttattcctggttatgtttttatctcacagcctattcaaaaagattttgaataattatttcaaaactttttgcaactttaataatcttaaataaccttaaaatatttaggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322769 - DNA, 932 bp, Homo sapiens
tcccccgggctcgcaggaattcggcacgagcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgtttataaactgccatgtaaatgtgttgttttccttttgcattccatttttgtgttcttgttttgcatcttttgccatacttacgtgagttactaataattgttacatactgtgggta

SEQ ID NO: 322770 - DNA, 2338 bp, Homo sapiens
tgggggaggagccccgcagcctccacctacaggggcgtcccctaaggggacggaggccgcatgggccgccgagccgggaaatctccgcccccagctggagcggctgtgcgggctgcgtagcggtgctgggtcgggccgacgtgccacccacccggagccgggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcatggaaccttgccgttggggaacctgacgtctaagtgtccagaaaggaggatgtgggcagggacggggtacagaggatagtgtgggtcagaggtgccagtagtataatattcatctccctggagttatgttgaaggcagagttttcatagggttagattttttttatccttttctagttcagttaattcatcctgttgaattgcaccatcgtgaaagatgggaaaaatcgtgatgatgggtaaggggaaaacttcccggaaggcaatggggcaaggaaaaagaaagcctatgggaaatggctgtgctcccaacatagctttgcagatgatgtgggttttttttttttttttttggttgtttgttttgagagagagtcttgctctgtctccctggctagggtgtggtggtgtgatcttggctcacggcagccttgccctccctggctcaagcagtcttcatctcagcctccagagtagctgggactacaggcatgtgatatgatgctcggctgatttttgtttactttttagagagatggggtcttgccatatttgccaggctggtttgaactcctacaactcaagcattcctcccaccttggtctcccaaaatgttgggaccacgggtgtgagccaccgcgcccagctagctcctgtgttttgtttttgttttgtaactttggttgatgttaaggccctccattttggaaagcaggaaaacaggatttttttttttttatcttgttccctggaggatccagggatgaggatagagtggcctgagagcagtgcttggattcagcctcctgctgggtccttctgctggatacaggcaccaagaggcgggggtggagcagggagctgcgccttcctggggtgcccggtggtgtgtagagaaaagctgcttgtttactccttaagtcaatgtattggtgactgttgatttgttggacaattcaggaatcaagggctgtggagaaactccctcatgttgttggcaacaggtgaatgaacctagagcggtgacatgaaaataaagctcactgttactcgctgtttttgtctttatttggtagtaaaaggtctttaaatacccaactattcatggaggtggcctccagggcttactgggttagctgaggaatctacataaaagta

SEQ ID NO: 322771 - DNA, 2761 bp, Homo sapiens
  misc_feature (1238)..(1238): n is a, c, g, or t
  misc_feature (1611)..(1611): n is a, c, g, or t
tgggggaggagccccgcagcctccacctacaggggcgtcccctaaggggacggaggccgcatgggccgccgagccgggaaatctccgcccccagctggagcggctgtgcgggctgcgtagcggtgctgggtcgggccgacgtgccacccacccggagccgggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcatggaaccttgccgttggggaacctgacgtctaagtgtccacatcactcgagacgtanattatggctgaatcatccgctaccttcacgagagaagaagaaggaggttcctgctgtgccagaaacccttaagaaaaagcgaaggaatttcgcagagctgaagatcaagcgcctgagaaagaagtttgcccaaaagatgctctctgcacaaggccaaggcaggcacagcttcatctcatgcacacacacagcaacagccactcatcgaccacaggcacatcatcagtgccagcatgtcaccagcacactgcacaattctgacatgggcgcaggcatgtgcaagcaacaagcttggcaacttctcatgtcacgctgcgagcaaccacaacattaggcagttttagtccatccagcacatccagcagtgtcatcnacatggcatgtgcagctcccaacagggttctgcaagcaggtgattgacagactatcttacgcacttctgtccaacatctttccacattggcacacccatttggtgcacagctccaacaaatgtgcttctgcattcaaccaatgcatgcagagcatatgtcagcagcgccatcatcattttgccatcggagggataaccgcccacatcgttgcacagctccacgtcacacactgcacacgtcagaatcttcacgaaagctgctgggcttcaatggtgccaacagatcccacatacagcaacagcggcacattggctctgtgccacccagccatcacaccgcctttatgcaatttgcgtccgcactcatcatttgcgctcacacaataccacagggcacatcatacgttgaccatcgcgagcgaatttatcgaatatccatgcagcatcttatcagctaggtgagcgacacaacaggcttataccacaaagcagtgccacacattacacgttcccgtgttgggcaccatcttcaacaatctggtcctttcatacaccaccagacaggtggcgacactcggcaccgcacaacacaggaacccaacccacgattcaatgggtaagacaacggtcgggcagcattggcatagggacacaccaggggcaagtggcacccaagcatccaaccacaggccttcatctacgcacacgaaattgaacgtcaaccgttgtcctcacccaattgcattcacagttggagcaatcacaggccaggagttgcgaacaaacgaacagacacacgggacaccatggctccctccgaatacattgtggcaacaaccaaaacgaaaagaaaccacaacaacaaacccaccaggccaggagaccagaacacaacaaacatagcagagagatcaacgcgcagaacaacagagcaagaagcaaccgacaacacaagggagcaccaagtgcaacacaaagaacacgagaaacaacgagctgacaacccagagagacactgaaatgcaacaacagaagcgtgggccaccaaccccgccgacggaaccaccaacaacaagagagaggacgacactcaacaccactgcaacacaacacgagcgtcaacagtcatgcacagaaaggcgacgcaaca

SEQ ID NO: 322772 - DNA, 572 bp, Homo sapiens
taggaaagaaaaacacacacaaaaatggatggagaatgtttgagggtaatttggacgttaaatttcttgattttgttaagtgtgctatgtattaaacaatgttcttattctttggaatacatttaggggtgatgggtttttatcttcaactaactctcaaatgattaaaaaaatataggtttactattttatacaatgtccctcagtttgggtttgtctgatgattcctcctgattgaatttgggttgtgcatttgagacaggcgtgccacagaagcgatgtcatgtcatttccagagcatcatgtcaggaggccctggatacttactcgtcccagtcctagggacgttcactttattcacttggttaaggtaatcatcactaggtttttccactgtaaagttgctattcttccatttgtaatttaaaaattggtgggctggctggttacagtggctcgtgcctgtaattgcagcactttgggatgctgaggcagaaggatcacttgagcccaggagttcgagaccaggctaggcaacatagcaagacctcatccctattttaaaaaataaa

SEQ ID NO: 322773 - DNA, 3452 bp, Homo sapiens
  misc_feature (741)..(741): n is a, c, g, or t
  misc_feature (744)..(744): n is a, c, g, or t
ctctcagtggtgcggccggcaggcagcgatggcggccgtacggggcctgcgggtgtcggtgaaggcggaggccccggcggggccggccctggggctcccgtcccctgaggcggagtccggtgttgaccgtggcgagccggagcccatggaggtggaggagggcgagctggaaatcgtgcctgtgcggcgctcgctcaaggaactgatcccggacacgagcagaagatatgaaaacaaggctggcagcttcatcactggaattgatgtcacctccaaggaagcaattgaaaagaaagagcagcgagccaagcgcttccattttcgatcggaagtaaatcttgcccaaagaaatgtagccttggaccgagacatgatgaagaaagcaatccccaaggtgagactggagacaatctatatttgcggagtagatgagatgagcacccaagatgtcttttcctattttaaagaatatcctccagctcacatcgaatggttggatgatacctcctgtaatgtagtttggctggatgaaatgacagccacacgagcacttatcaatatgagctccctgcctgcacaggataagatcagaagcagggatgccagtgaggacaagtcagctgagaaaaggaaaaaagacaagcaggaagacagttcagatgatgatgaagctgaagaaggagaggttgaagatgagaactcaagtgatgtagagttggatacgttgtctcaggtagaagnggngtctttgttaagaaacgatcttcgtccagctaacaaacttgctaaaggaaataggttattcatgagatttgctacaaaagccccaggtctaggatccatccaggactgagtgtatgacaaaaaggaacttggagcagccagaagaagtcagtattacatgaaatatgggaatccaaattatggaggcatgaaaggaattcttagcaattcatggaagcgaagatatcattcccgtcgtattcagcgggacgtgatcaagaagagagccctgattggggatgacgttggcttgacgtcgtataaacatcgacattctgggctagtgaatgttcccgaggaacccattgaagaggaggaagaggaggaggaggaggaagaggaagaggaagaagaagaccaggacatggatgcagatgacagagtggtggtagagtaccacgaggagctcccggctctcaagcagccccgggagcggagcgcgtctagacgatccagtgccagcagctcagactcagatgaaatggactatgatctagaactgaaaatgatttccacgccttcaccaaagaaaagcatgaaaatgactatgtatgctgacgaagtggaatctcagttgaaaaatattaggaactccatgagggcagatagtgtatcttcaagcaatatcaaaaaccgaattggtaacaaattaccacctgagaaatttgcagatgtccgacatctattagatgagaaacgtcagcactcccgtccacggccaccagtcagcagtactaaatcagatatacgccagcggttaggaaaaagaccacattctccggaaaaggcttttagtagtaaccccgtcgttcggagagagccctcttctgatgtgcatagtaggctaggtgttcccaggcaggatagtaaaggcctctacgccgatactcgggagaagaaatcaggtaatttatggactcgcctaggatctgcacccaagaccaaagaaaagaatacgaagaaagtggatcacagggcgcctggcgctgaggaagacgactctgagctgcaaagggcatggggggctctgattaaggagaaagagcagtctcgccaaaagaagagccggttagataacttaccatctctccagattgaagttagtcgggaaagcagctctggttcagaggcagagtcctgatgcccctggggcctatggcagctgccctaaagcctgacattcttgcacagggtggggcgcgcagtaggaacctcccccgcaggagctggcgccctctcgctcctgctcacacagtcaccctccgctcttgctacttcggcaagacatcttaagaatgtgacacattttcaagggcatctctatctttcgctgcagagttgtagttctgggccctcgattcctttcccaccaccccacaggctttaccctttgagaaaaaggcagccctccagattttgtagacatttttcttaatatttttaacattgtgtcttttaaaagaaatgttttacacagttcatccaaagagcagagaactgaacttctcactattgccttggccctgacagctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatgaatgatttgaaagtttaaatttttaatttttatatgtggaaattcttcctgttggctaaaggggaagctcaagtggtgtcgtcttttgtgctgttaaatatatattctattctttggaagaaggcagagagaggagtcttattatttttaaatgctcctagttgtatagtctgtctgttgtacatagagttcagcttgttttttggctccagtaggaaaaaaaatccatccatctgagatggggtcctgttgtttattatcactctagaagttatacattgatatttattctttctgtccccacgttgtggcacctgaagacatcttcaaaattggcagaaaagataatagttataaaaattttagttcatttatttttaaactcctttcagattattttaccattaggaggaggtagattgtttcgtcttcctgtctgatttttgttttgtagtatttaattttgtattcctctgcagttttaagaaacagtgtttttcttcggtttgctggaacatgggcgttagagatggtaataaaccgtggtcctttttgcgatgtcacgactcttcacctgcctgggctgttgtgcacacagtgcagcctggatcctgtcgatctttacttgtggcggagctaatggtcacattgatagttgattacactgtggcacgaattaatgcagaacactgttattaataaaggaagtaaagggctgcaagatttgagagctgcaacaaaaaaaatatt

SEQ ID NO: 322774 - DNA, 3666 bp, Homo sapiens
  misc_feature (741)..(741): n is a, c, g, or t
  misc_feature (744)..(744): n is a, c, g, or t
ctctcagtggtgcggccggcaggcagcgatggcggccgtacggggcctgcgggtgtcggtgaaggcggaggccccggcggggccggccctggggctcccgtcccctgaggcggagtccggtgttgaccgtggcgagccggagcccatggaggtggaggagggcgagctggaaatcgtgcctgtgcggcgctcgctcaaggaactgatcccggacacgagcagaagatatgaaaacaaggctggcagcttcatcactggaattgatgtcacctccaaggaagcaattgaaaagaaagagcagcgagccaagcgcttccattttcgatcggaagtaaatcttgcccaaagaaatgtagccttggaccgagacatgatgaagaaagcaatccccaaggtgagactggagacaatctatatttgcggagtagatgagatgagcacccaagatgtcttttcctattttaaagaatatcctccagctcacatcgaatggttggatgatacctcctgtaatgtagtttggctggatgaaatgacagccacacgagcacttatcaatatgagctccctgcctgcacaggataagatcagaagcagggatgccagtgaggacaagtcagctgagaaaaggaaaaaagacaagcaggaagacagttcagatgatgatgaagctgaagaaggagaggttgaagatgagaactcaagtgatgtagagttggatacgttgtctcaggtagaagnggngtctttgttaagaaacgatcttcgtccagctaacaaacttgctaaaggaaataggttattcatgagatttgctacaaaagccccaggtctaggatccatccaggactgagtgtactcattttgcatcttacctgctccacatctggaatcagccatttctccaaggagctggtgggcatggtttgaggggttcgggggttgggggctatacatactggtttgtgttgtcacgtttacctacagccctggatatatttacagtggtgtttgttctttacagtcagagtgtccaagaactgtggaaggtctttgtattactacttttgacaaaaatttatgatgactgaccacctttctttcctgttaactgacatttcaacttgacaaatgtgatctttaccacattgactcatttgagtggctgagtacattctacatgtatagtattatgctgttttctttaagccattttgaggagcacaataaactggaaaaatgatttaccaaatatatggaattatatgtagtctgtttccttaatcctgatgctgtgttgttggcatgtgatccttcagaagtgaatatcatctttcatggggtggcaaaaatgccactattttgagaaagtctttttgattcctgggtacctgtaatgacctaaagctcttttatgccttttggaaccttgtatcttgtattgtttatttttgttttctccattaagtcatctggctccaaacagcagttttaacctcattcgtctctgtattttgctttatcccctctacactgcattgctgtagtgggcactcagagtgtgaatgttggtagtggatttttactttttgttggcaaattgcgctgatctgattccagctatggaaaacattaaaaaaaaaattcaacattgtctttacactcacaggaaatcctaggtaactattgtcattaatttttagatgacaaaaaggaacttggagcagccagaagaagtcagtattacatgaaatatgggaatccaaattatggaggcatgaaaggaattcttagcaattcatggaagcgaagatatcattcccgtcgtattcagcgggacgtgatcaagaagagagccctgattggggatgacgttggcttgacgtcgtataaacatcgacattctgggctagtgaatgttcccgaggaacccattgaagaggaggaagaggaggaggaggaggaagaggaagaggaagaagaagaccaggacatggatgcagatgacagagtggtggtagagtaccacgaggagctcccggctctcaagcagccccgggagcggagcgcgtctagacgatccagtgccagcagctcagactcagatgaaatggactatgatctagaactgaaaatgatttccacgccttcaccaaagaaaagcatgaaaatgactatgtatgctgacgaagtggaatctcagttgaaaaatattaggaactccatgagggcagatagtgtatcttcaagcaatatcaaaaaccgaattggtaacaaattaccacctgagaaatttgcagatgtccgacatctattagatgagaaacgtcagcactcccgtccacggccaccagtcagcagtactaaatcagatatacgccagcggttaggaaaaagaccacattctccggaaaaggcttttagtagtaaccccgtcgttcggagagagccctcttctgatgtgcatagtaggctaggtgttcccaggcaggatagtaaaggcctctacgccgatactcgggagaagaaatcaggtaatttatggactcgcctaggatctgcacccaagaccaaagaaaagaatacgaagaaagtggatcacagggcgcctggcgctgaggaagacgactctgagctgcaaagggcatggggggctctgattaaggagaaagagcagtctcgccaaaagaagagccggttagataacttaccatctctccagattgaagttagtcgggaaagcagctctggttcagaggcagagtcctgatgcccctggggcctatggcagctgccctaaagcctgacattcttgcacagggtggggcgcgcagtaggaacctcccccgcaggagctggcgccctctcgctcctgctcacacagtcaccctccgctcttgctacttcggcaagacatcttaagaatgtgacacattttcaagggcatctctatctttcgctgcagagttgtagttctgggccctcgattcctttcccaccaccccacaggctttaccctttgagaaaaaggcagccctccagattttgtagacatttttcttaatatttttaacattgtgtcttttaaaagaaatgttttacacagttcatccaaagagcagagaactgaacttctcactattgccttggccctgacagctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatgaatgatttgaaagtttaaatttttaatttttatatgtggaaattcttcctgttggctaaaggggaagctcaagtggtgtcgtcttttgtgctgttaaatatatattctattctttgga

SEQ ID NO: 322775 - DNA, 3836 bp, Homo sapiens
  misc_feature (741)..(741): n is a, c, g, or t
  misc_feature (744)..(744): n is a, c, g, or t
ctctcagtggtgcggccggcaggcagcgatggcggccgtacggggcctgcgggtgtcggtgaaggcggaggccccggcggggccggccctggggctcccgtcccctgaggcggagtccggtgttgaccgtggcgagccggagcccatggaggtggaggagggcgagctggaaatcgtgcctgtgcggcgctcgctcaaggaactgatcccggacacgagcagaagatatgaaaacaaggctggcagcttcatcactggaattgatgtcacctccaaggaagcaattgaaaagaaagagcagcgagccaagcgcttccattttcgatcggaagtaaatcttgcccaaagaaatgtagccttggaccgagacatgatgaagaaagcaatccccaaggtgagactggagacaatctatatttgcggagtagatgagatgagcacccaagatgtcttttcctattttaaagaatatcctccagctcacatcgaatggttggatgatacctcctgtaatgtagtttggctggatgaaatgacagccacacgagcacttatcaatatgagctccctgcctgcacaggataagatcagaagcagggatgccagtgaggacaagtcagctgagaaaaggaaaaaagacaagcaggaagacagttcagatgatgatgaagctgaagaaggagaggttgaagatgagaactcaagtgatgtagagttggatacgttgtctcaggtagaagnggngtctttgttaagaaacgatcttcgtccagctaacaaacttgctaaaggaaataggttattcatgagatttgctacaaaagccccaggtctaggatccatccaggactgagtgtactcattttgcatcttacctgctccacatctggaatcagccatttctccaaggagctggtgggcatggtttgaggggttcgggggttgggggctatacatactggtttgtgttgtcacgtttacctacagccctggatatatttacagtggtgtttgttctttacagtcagagtgtccaagaactgtggaaggtctttgtattactacttttgacaaaaatttatgatgactgaccacctttctttcctgttaactgacatttcaacttgacaaatgtgatctttaccacattgactcatttgagtggctgagtacattctacatgtatagtattatgctgttttctttaagccattttgaggagcacaataaactggaaaaatgatttaccaaatatatggaattatatgtagtctgtttccttaatcctgatgctgtgttgttggcatgtgatccttcagaagtgaatatcatctttcatggggtggcaaaaatgccactattttgagaaagtctttttgattcctgggtacctgtaatgacctaaagctcttttatgccttttggaaccttgtatcttgtattgtttatttttgttttctccattaagtcatctggctccaaacagcagttttaacctcattcgtctctgtattttgctttatcccctctacactgcattgctgtagtgggcactcagagtgtgaatgttggtagtggatttttactttttgttggcaaattgcgctgatctgattccagctatggaaaacattaaaaaaaaaattcaacattgtctttacactcacaggaaatcctaggtaactattgtcattaatttttagatgacaaaaaggaacttggagcagccagaagaagtcagtattacatgaaatatgggaatccaaattatggaggcatgaaaggaattcttagcaattcatggaagcgaagatatcattcccgtcgtattcagcgggacgtgatcaagaagagagccctgattggggatgacgttggcttgacgtcgtataaacatcgacattctgggctagtgaatgttcccgaggaacccattgaagaggaggaagaggaggaggaggaggaagaggaagaggaagaagaagaccaggacatggatgcagatgacagagtggtggtagagtaccacgaggagctcccggctctcaagcagccccgggagcggagcgcgtctagacgatccagtgccagcagctcagactcagatgaaatggactatgatctagaactgaaaatgatttccacgccttcaccaaagaaaagcatgaaaatgactatgtatgctgacgaagtggaatctcagttgaaaaatattaggaactccatgagggcagatagtgtatcttcaagcaatatcaaaaaccgaattggtaacaaattaccacctgagaaatttgcagatgtccgacatctattagatgagaaacgtcagcactcccgtccacggccaccagtcagcagtactaaatcagatatacgccagcggttaggaaaaagaccacattctccggaaaaggcttttagtagtaaccccgtcgttcggagagagccctcttctgatgtgcatagtaggctaggtgttcccaggcaggatagtaaaggcctctacgccgatactcgggagaagaaatcaggtaatttatggactcgcctaggatctgcacccaagaccaaagaaaagaatacgaagaaagtggatcacagggcgcctggcgctgaggaagacgactctgagctgcaaagggcatggggggctctgattaaggagaaagagcagtctcgccaaaagaagagccgctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatgaatgatttgaaagtttaaatttttaatttttatatgtggaaattcttcctgttggctaaaggggaagctcaagtggtgtcgtcttttgtgctgttaaatatatattctattctttggaagaaggcagagagaggagtcttattatttttaaatgctcctagttgtatagtctgtctgttgtacatagagttcagcttgttttttggctccagtaggaaaaaaaatccatccatctgagatggggtcctgttgtttattatcactctagaagttatacattgatatttattctttctgtccccacgttgtggcacctgaagacatcttcaaaattggcagaaaagataatagttataaaaattttagttcatttatttttaaactcctttcagattattttaccattaggaggaggtagattgtttcgtcttcctgtctgatttttgttttgtagtatttaattttgtattcctctgcagttttaagaaacagtgtttttcttcggtttgctggaacatgggcgttagagatggtaataaaccgtggtcctttttgcgatgtcacgactcttcacctgcctgggctgttgtgcacacagtgcagcctggatcctgtcgatctttacttgtggcggagctaatggtcacattgatagttgattacactgtggcacgaattaatgcagaacactgttattaataaaggaagtaaagggctgcaagatttgagagctgcaacaaaaaaaatatt

SEQ ID NO: 322776 - DNA, 1604 bp, Homo sapiens
ccactgatttaccgaaatttcgagcctcgggtaccccttcgattgtgggctcagaggttcagaggcagagtcctgatgcccctggggcctatggcagctgccctaaagcctgacattcttgcacagggtggggcgcgcagtaggaacctcccccgcaggagctggcgccctctcgctcctgctcacacagtcaccctccgctcttgctacttcggcaagacatcttaagaatgtgacacattttcaagggcatctctatctttcgctgcagagttgtagttctgggccctcgattcctttcccaccaccccacaggctttaccctttgagaaaaaggcagccctccagattttgtagacatttttcttaatatttttaacattgtgtcttttaaaagaaatgttttacacagttcatccaaagagcagagaactgaacttctcactattgccttggccctgacagctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatgaatgatttgaaagtttaaatttttaatttttatatgtggaaattcttcctgttggctaaaggggaagctcaagtggtgtcgtcttttgtgctgttaaatatatattctattctttggaagaaggcagagagaggagtcttattatttttaaatgctcctagttgtatagtctgtctgttgtacatagagttcagcttgttttttggctccagtaggaaaaaaaatccatccatctgagatggggtcctgttgtttattatcactctagaagttatacattgatatttattctttctgtccccacgttgtggcacctgaagacatcttcaaaattggcagaaaagataatagttataaaaattttagttcatttatttttaaactcctttcagattattttaccattaggaggaggtagattgtttcgtcttcctgtctgatttttgttttgtagtatttaattttgtattcctctgcagttttaagaaacagtgtttttcttcggtttgctggaacatgggcgttagagatggtaataaaccgtggtcctttttgcgatgtcacgactcttcacctgcctgggctgttgtgcacacagtgcagcctggatcctgtcgatctttacttgtggcggagctaatggtcacattgatagttgattacactgtggcacgaattaatgcagaacactgttattaataaaggaagtaaagggctgcaagatttgagagctgcaacaaaaaaaatatt

SEQ ID NO: 322777 - DNA, 1249 bp, Homo sapiens
  misc_feature (741)..(741): n is a, c, g, or t
  misc_feature (744)..(744): n is a, c, g, or t
ctctcagtggtgcggccggcaggcagcgatggcggccgtacggggcctgcgggtgtcggtgaaggcggaggccccggcggggccggccctggggctcccgtcccctgaggcggagtccggtgttgaccgtggcgagccggagcccatggaggtggaggagggcgagctggaaatcgtgcctgtgcggcgctcgctcaaggaactgatcccggacacgagcagaagatatgaaaacaaggctggcagcttcatcactggaattgatgtcacctccaaggaagcaattgaaaagaaagagcagcgagccaagcgcttccattttcgatcggaagtaaatcttgcccaaagaaatgtagccttggaccgagacatgatgaagaaagcaatccccaaggtgagactggagacaatctatatttgcggagtagatgagatgagcacccaagatgtcttttcctattttaaagaatatcctccagctcacatcgaatggttggatgatacctcctgtaatgtagtttggctggatgaaatgacagccacacgagcacttatcaatatgagctccctgcctgcacaggataagatcagaagcagggatgccagtgaggacaagtcagctgagaaaaggaaaaaagacaagcaggaagacagttcagatgatgatgaagctgaagaaggagaggttgaagatgagaactcaagtgatgtagagttggatacgttgtctcaggtagaagnggngtctttgttaagaaacgatcttcgtccagctaacaaacttgctaaaggaaataggttattcatgagatttgctacaaaagccccaggtctaggatccatccaggactgagtgtactcattttgcatcttacctgctccacatctggaatcagccatttctccaaggagctggtgggcatggtttgaggggttcgggggttgggggctatacatactggtttgtgttgtcacgtttacctacagccctggatatatttacagtggtgtttgttctttacagtcagagtgtccaagaactgtggaaggtctttgtattactacttttgacaaaaatttatgatgactgaccacctttctttcctgttaactgacatttcaacttgacaaatgtgatctttaccacattgactcatttgagtggctgagtacattctacatgtatagtattatgctgttttctttaagccattttgaggagcacaataaactggaaaaatgatttacc

SEQ ID NO: 322778 - DNA, 1326 bp, Homo sapiens
  misc_feature (741)..(741): n is a, c, g, or t
  misc_feature (744)..(744): n is a, c, g, or t
ctctcagtggtgcggccggcaggcagcgatggcggccgtacggggcctgcgggtgtcggtgaaggcggaggccccggcggggccggccctggggctcccgtcccctgaggcggagtccggtgttgaccgtggcgagccggagcccatggaggtggaggagggcgagctggaaatcgtgcctgtgcggcgctcgctcaaggaactgatcccggacacgagcagaagatatgaaaacaaggctggcagcttcatcactggaattgatgtcacctccaaggaagcaattgaaaagaaagagcagcgagccaagcgcttccattttcgatcggaagtaaatcttgcccaaagaaatgtagccttggaccgagacatgatgaagaaagcaatccccaaggtgagactggagacaatctatatttgcggagtagatgagatgagcacccaagatgtcttttcctattttaaagaatatcctccagctcacatcgaatggttggatgatacctcctgtaatgtagtttggctggatgaaatgacagccacacgagcacttatcaatatgagctccctgcctgcacaggataagatcagaagcagggatgccagtgaggacaagtcagctgagaaaaggaaaaaagacaagcaggaagacagttcagatgatgatgaagctgaagaaggagaggttgaagatgagaactcaagtgatgtagagttggatacgttgtctcaggtagaagnggngtctttgttaagaaacgatcttcgtccagctaacaaacttgctaaaggaaataggttattcatgagatttgctacaaaagccccaggtctaggatccatccaggactgagtgtgtaagtatgtaatgtttccttagtcccccttaagctgaaactacttctatcctcccatgttttccaagaatataggtttactattttatacaatgtccctcagtttgggtttgtctgatgattcctcctgattgaatttgggttgtgcatttgagacaggcgtgccacagaagcgatgtcatgtcatttccagagcatcatgtcaggaggccctggatacttactcgtcccagtcctagggacgttcactttattcacttggttaaggtaatcatcactaggtttttccactgtaaagttgctattcttccatttgtaatttaaaaattggtgggctggctggttacagtggctcgtgcctgtaattgcagcactttgggatgctgaggcagaaggatcacttgagcccaggagttcgagaccaggctaggcaacatagcaagacctcatccctattttaaaaaataaa

SEQ ID NO: 322779 - DNA, 399 bp, Homo sapiens
gacttgtagttgtatgctgtgtaatagcacatacacatgtggaaaccaccttcgaaaacctgctcaccagaaccagtctctttagagcaggcagatcatggtttccataagcaaataattataagtttatggatttgtaagtgaatgttggccatgtaagacaggatttcttaaattgtttcctccaaagtatgagattgttgtttgggccttgtctcacagttgaagttggttaactgtgccccatcctaccccctttttaaaggaactccatgagggcagatagtgtatcttcaagcaatatcaaaaaccgaattggtaacaaattaccacctgagaaatttgcagatgtccgacatctattagatgagaaacgtcagcactcccgtccacggccac

SEQ ID NO: 322780 - DNA, 529 bp, Homo sapiens
cagttgttccaataatgtcctttatatattccccgcccagccccaggtctaggatccatccaggactgagtgtgtaagtatgtaatgtttccttagtcccccttaagctgaaactacttctatcctcccatgttttccaagaatataggtttactattttatacaatgtccctcagtttgggtttgtctgatgattcctcctgattgaatttgggttgtgcatttgagacaggcgtgccacagaagcgatgtcatgtcatttccagagcatcatgtcaggaggccctggatacttactcgtcccagtcctagggacgttcactttattcacttggttaaggtaatcatcactaggtttttccactgtaaagttgctattcttccatttgtaatttaaaaattggtgggctggctggttacagtggctcgtgcctgtaattgcagcactttgggatgctgaggcagaaggatcacttgagcccaggagttcgagaccaggctaggcaacatagcaagacctcatccctat

SEQ ID NO: 322781 - DNA, 3051 bp, Homo sapiens
tggggttcaccatgttggccaggatggtctcgatctcttgaccttgtgatccgcccgcctcagcctcccaaagtactgggattacaggcgtgagccatcgcgcccagcctaatatcagtattttaatttacaaattgtcttggatttggccagtagagccccttcaagctgttttgacatactccatgattctttaagcactttctttctttatggcacaacaaaacatcttgcttttccagactcattttgcatcttacctgctccacatctggaatcagccatttctccaaggagctggtgggcatggtttgaggggttcgggggttgggggctatacatactggtttgtgttgtcacgtttacctacagccctggatatatttacagtggtgtttgttctttacagtcagagtgtccaagaactgtggaaggtctttgtattactacttttgacaaaaatttatgatgactgaccacctttctttcctgttaactgacatttcaacttgacaaatgtgatctttaccacattgactcatttgagtggctgagtacattctacatgtatagtattatgctgttttctttaagccattttgaggagcacaataaactggaaaaatgatttaccaaatatatggaattatatgtagtctgtttccttaatcctgatgctgtgttgttggcatgtgatccttcagaagtgaatatcatctttcatggggtggcaaaaatgccactattttgagaaagtctttttgattcctgggtacctgtaatgacctaaagctcttttatgccttttggaaccttgtatcttgtattgtttatttttgttttctccattaagtcatctggctccaaacagcagttttaacctcattcgtctctgtattttgctttatcccctctacactgcattgctgtagtgggcactcagagtgtgaatgttggtagtggatttttactttttgttggcaaattgcgctgatctgattccagctatggaaaacattaaaaaaaaaattcaacattgtctttacactcacaggaaatcctaggtaactattgtcattaatttttagatgacaaaaaggaacttggagcagccagaagaagtcagtattacatgaaatatgggaatccaaattatggaggcatgaaaggaattcttagcaattcatggaagcgaagatatcattcccgtcgtattcagcgggacgtgatcaagaagagagccctgattggggatgacgttggcttgacgtcgtataaacatcgacattctgggctagtgaatgttcccgaggaacccattgaagaggaggaagaggaggaggaggaggaagaggaagaggaagaagaagaccaggacatggatgcagatgacagagtggtggtagagtaccacgaggagctcccggctctcaagcagccccgggagcggagcgcgtctagacgatccagtgccagcagctcagactcagatgaaatggactatgatctagaactgaaaatgatttccacgccttcaccaaagaaaagcatgaaaatgactatgtatgctgacgaagtggaatctcagttgaaaaatattaggaactccatgagggcagatagtgtatcttcaagcaatatcaaaaaccgaattggtaacaaattaccacctgagaaatttgcagatgtccgacatctattagatgagaaacgtcagcactcccgtccacggccaccagtcagcagtactaaatcagatatacgccagcggttaggaaaaagaccacattctccggaaaaggcttttagtagtaaccccgtcgttcggagagagccctcttctgatgtgcatagtaggctaggtgttcccaggcaggatagtaaaggcctctacgccgatactcgggagaagaaatcaggtaatttatggactcgcctaggatctgcacccaagaccaaagaaaagaatacgaagaaagtggatcacagggcgcctggcgctgaggaagacgactctgagctgcaaagggcatggggggctctgattaaggagaaagagcagtctcgccaaaagaagagccggttagataacttaccatctctccagattgaagttagtcgggaaagcagctctggttcagaggcagagtcctgatgcccctggggcctatggcagctgccctaaagcctgacattcttgcacagggtggggcgcgcagtaggaacctcccccgcaggagctggcgccctctcgctcctgctcacacagtcaccctccgctcttgctacttcggcaagacatcttaagaatgtgacacattttcaagggcatctctatctttcgctgcagagttgtagttctgggccctcgattcctttcccaccaccccacaggctttaccctttgagaaaaaggcagccctccagattttgtagacatttttcttaatatttttaacattgtgtcttttaaaagaaatgttttacacagttcatccaaagagcagagaactgaacttctcactattgccttggccctgacagctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatgaatgatttgaaagtttaaatttttaatttttatatgtggaaattcttcctgttggctaaaggggaagctcaagtggtgtcgtcttttgtgctgttaaatatatattctattctttgga

SEQ ID NO: 322782 - DNA, 3581 bp, Homo sapiens
  misc_feature (741)..(741): n is a, c, g, or t
  misc_feature (744)..(744): n is a, c, g, or t
ctctcagtggtgcggccggcaggcagcgatggcggccgtacggggcctgcgggtgtcggtgaaggcggaggccccggcggggccggccctggggctcccgtcccctgaggcggagtccggtgttgaccgtggcgagccggagcccatggaggtggaggagggcgagctggaaatcgtgcctgtgcggcgctcgctcaaggaactgatcccggacacgagcagaagatatgaaaacaaggctggcagcttcatcactggaattgatgtcacctccaaggaagcaattgaaaagaaagagcagcgagccaagcgcttccattttcgatcggaagtaaatcttgcccaaagaaatgtagccttggaccgagacatgatgaagaaagcaatccccaaggtgagactggagacaatctatatttgcggagtagatgagatgagcacccaagatgtcttttcctattttaaagaatatcctccagctcacatcgaatggttggatgatacctcctgtaatgtagtttggctggatgaaatgacagccacacgagcacttatcaatatgagctccctgcctgcacaggataagatcagaagcagggatgccagtgaggacaagtcagctgagaaaaggaaaaaagacaagcaggaagacagttcagatgatgatgaagctgaagaaggagaggttgaagatgagaactcaagtgatgtagagttggatacgttgtctcaggtagaagnggngtctttgttaagaaacgatcttcgtccagctaacaaacttgctaaaggaaataggttattcatgagatttgctacaaaagccccaggtctaggatccatccaggactgagtgtactcattttgcatcttacctgctccacatctggaatcagccatttctccaaggagctggtgggcatggtttgaggggttcgggggttgggggctatacatactggtttgtgttgtcacgtttacctacagccctggatatatttacagtggtgtttgttctttacagtcagagtgtccaagaactgtggaaggtctttgtattactacttttgacaaaaatttatgatgactgaccacctttctttcctgttaactgacatttcaacttgacaaatgtgatctttaccacattgactcatttgagtggctgagtacattctacatgtatagtattatgctgttttctttaagccattttgaggagcacaataaactggaaaaatgatttaccaaatatatggaattatatgtagtctgtttccttaatcctgatgctgtgttgttggcatgtgatccttcagaagtgaatatcatctttcatggggtggcaaaaatgccactattttgagaaagtctttttgattcctgggtacctgtaatgacctaaagctcttttatgccttttggaaccttgtatcttgtattgtttatttttgttttctccattaagtcatctggctccaaacagcagttttaacctcattcgtctctgtattttgctttatcccctctacactgcattgctgtagtgggcactcagagtgtgaatgttggtagtggatttttactttttgttggcaaattgcgctgatctgattccagctatggaaaacattaaaaaaaaaattcaacattgtctttacactcacaggaaatcctaggtaactattgtcattaatttttagatgacaaaaaggaacttggagcagccagaagaagtcagtattacatgaaatatgggaatccaaattatggaggcatgaaaggaattcttagcaattcatggaagcgaagatatcattcccgtcgtattcagcgggacgtgatcaagaagagagccctgattggggatgacgttggcttgacgtcgtataaacatcgacattctgggctagtgaatgttcccgaggaacccattgaagaggaggaagaggaggaggaggaggaagaggaagaggaagaagaagaccaggacatggatgcagatgacagagtggtggtagagtaccacgaggagctcccggctctcaagcagccccgggagcggagcgcgtctagacgatccagtgccagcagctcagactcagatgaaatggactatgatctagaactgaaaatgatttccacgccttcaccaaagaaaagcatgaaaatgactatgtatgctgacgaagtggaatctcagttgaaaaatattaggaactccatgagggcagatagtgtatcttcaagcaatatcaaaaaccgaattggtaacaaattaccacctgagaaatttgcagatgtccgacatctattagatgagaaacgtcagcactcccgtccacggccaccagtcagcagtactaaatcagatatacgccagcggttaggaaaaagaccacattctccggaaaaggcttttagtagtaaccccgtcgttcggagagagccctcttctgatgtgcatagtaggctaggtgttcccaggcaggatagtaaaggcctctacgccgatactcgggagaagaaatcaggtaatttatggactcgcctaggatctgcacccaagaccaaagaaaagaatacgaagaaagtggatcacagggcgcctggcgctgaggaagacgactctgagctgcaaagggcatggggggctctgattaaggagaaagagcagtctcgccaaaagaagagccggttagataacttaccatctctccagattgaagttagtcgggaaagcagctctggttcagaggcagagtcctgatgcccctggggcctatggcagctgccctaaagcctgacattcttgcacagggtggggcgcgcagtaggaacctcccccgcaggagctggcgccctctcgctcctgctcacacagtcaccctccgctcttgctacttcggcaagacatcttaagaatgtgacacattttcaagggcatctctatctttcgctgcagagttgtagttctgggccctcgattcctttcccaccaccccacaggctttaccctttgagaaaaaggcagccctccagattttgtagacatttttcttaatatttttaacattgtgtcttttaaaagaaatgttttacacagttcatccaaagagcagagaactgaacttctcactattgccttggccctgacagctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatggcgccggctggcccagcacattagattgagcag

SEQ ID NO: 322783 - DNA, 1680 bp, Homo sapiens
  misc_feature (741)..(741): n is a, c, g, or t
  misc_feature (744)..(744): n is a, c, g, or t
ctctcagtggtgcggccggcaggcagcgatggcggccgtacggggcctgcgggtgtcggtgaaggcggaggccccggcggggccggccctggggctcccgtcccctgaggcggagtccggtgttgaccgtggcgagccggagcccatggaggtggaggagggcgagctggaaatcgtgcctgtgcggcgctcgctcaaggaactgatcccggacacgagcagaagatatgaaaacaaggctggcagcttcatcactggaattgatgtcacctccaaggaagcaattgaaaagaaagagcagcgagccaagcgcttccattttcgatcggaagtaaatcttgcccaaagaaatgtagccttggaccgagacatgatgaagaaagcaatccccaaggtgagactggagacaatctatatttgcggagtagatgagatgagcacccaagatgtcttttcctattttaaagaatatcctccagctcacatcgaatggttggatgatacctcctgtaatgtagtttggctggatgaaatgacagccacacgagcacttatcaatatgagctccctgcctgcacaggataagatcagaagcagggatgccagtgaggacaagtcagctgagaaaaggaaaaaagacaagcaggaagacagttcagatgatgatgaagctgaagaaggagaggttgaagatgagaactcaagtgatgtagagttggatacgttgtctcaggtagaagnggngtctttgttaagaaacgatcttcgtccagctaacaaacttgctaaaggaaataggttattcatgagatttgctacaaaagccccaggtctaggatccatccaggactgagtgtactcattttgcatcttacctgctccacatctggaatcagccatttctccaaggagctggtgggcatggtttgaggggttcgggggttgggggctatacatactggtttgtgttgtcacgtttacctacagccctggatatatttacagtggtgtttgttctttacagtcagagtgtccaagaactgtggaaggtctttgtattactacttttgacaaaaatttatgatgactgaccacctttctttcctgttaactgacatttcaacttgacaaatgtgatctttaccacattgactcatttgagtggctgagtacattctacatgtatagtattatgctgttttctttaagccattttgaggagcacaataaactggaaaaatgatttaccaaatatatggaattatatgtagtctgtttccttaatcctgatgctgtgttgttggcatgtgatccttcagaagtgaatatcatctttcatggggtggcaaaaatgccactattttgagaaagtctttttgattcctgggtacctgtaatgacctaaagctcttttatgccttttggaaccttgtatcttgtattgtttatttttgttttctccattaagtcatctggctccaaacagcagttttaacctcattcgtctctgtattttgctttatcccctctacactgcattgctgtagtgggcactcagagtgtgaatgttggtagtggatttttactttttgttggcaaattgcgctgatctgattccagctatggaaaacattaaaaaaagtcgacgcggccgcgaatttagtagtagtaggcggccgc

SEQ ID NO: 322784 - DNA, 641 bp, Homo sapiens
ttgcggacaggaaaattctatcatcttttctgtgtcttgtctttctagcaatccccaaggtgagactggagacaatctatatttgcggagtagatgagatgagcacccaagatgtcttttcctattttaaagaatatcctccagctcacatcgaatggttggatgatacctcctgtaagtacacccgagtttcctgtgaatatgcttttgttgatgatttttcaagagttcttgccatcagagatggtgaatggttctggcccatactacttgtttatgccgaacttctgctgttagtccaggagagaaaaaattgtcgagcagtgaaacgcagcatgcccttgccagtctgccagctcataccccatagtgtcccacgtcagctgagaggtggtggccagggctctaggaggtgggttactggcctctgaatctgccgtagttgattgaggcctctttaacactcaccttttcccaacaaaggagaggatccaactgcgtagacttggggctgcattttcagagccttggactttgtcattactgccttctgtactgttactcagagggctgactctgcctgtgtctctgacctagagatagaccagaatagacactggacagagtgtcattctgaatag

SEQ ID NO: 322785 - DNA, 1210 bp, Homo sapiens
agcggagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagc

SEQ ID NO: 322786 - DNA, 1545 bp, Homo sapiens
agcggagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagcattggcatatggagttttctttttaaagcattataaagaacaatttctttgtttaatagaacaacctgatctacatatatgatagtatatgatccaaacaataatgctgtgaacttaatgggtctggtattatccccattttacagatggtagaactgagatgcattcaacacactgagatacgttcaacacaccattgggaatcatcagcaaaatccagcatgaagagtctctacaggataagtagcctagatttttccaacaaataaatgataggagggaaaaatggtggggtactatcatagattttaaaaggcttaagagacatacgagcc

SEQ ID NO: 322787 - DNA, 1242 bp, Homo sapiens
agcggagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagccaaaaaaaaatagtaaagataaaaaaaaaaaa

SEQ ID NO: 322788 - DNA, 1014 bp, Homo sapiens
agcggagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggc

SEQ ID NO: 322789 - DNA, 1082 bp, Homo sapiens
tgtggcaggatcctccttcatgagaagatggaagcatggtgttgtttttgcctggttttgctcaaatgtcatgcacaccaaggcaccttttgattgtaaaccagcctttcctgtattggtctgcgtacaccatgattgtcccttaggggaactgtgagtgtggggctcctctgtcctcatggagttggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagc

SEQ ID NO: 322790 - DNA, 1140 bp, Homo sapiens
agcggagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcctggtctctctcagcctgggtctgcct

SEQ ID NO: 322791 - DNA, 1156 bp, Homo sapiens
agcggagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagc

SEQ ID NO: 322792 - DNA, 1212 bp, Homo sapiens
agcgaagtgaacgccgtttgctgagcctgatgcccagcgagaggcgatacacgataaataagctcctcataactgtctctcaatatgacgatgtatcacccggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagc

SEQ ID NO: 322793 - DNA, 922 bp, Homo sapiens
agcggagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctaatttagcaaaaagcttcgtgccgctcg

SEQ ID NO: 322794 - DNA, 1176 bp, Homo sapiens
agcggagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggagggtaacacgtgcctggctggattgttgcggggatgcttggagctttctgagtggggcagtgaacaggctgaaaccctcgcttgttgggaagtcacagaatcctcccttgtgtagtcctgagaaacactggtccatgtgacaagggccacacccagaaagtctgtccttggtttctgcgatggcttccccaggctttagcagatgatttttagtggaacgcgcagtctgtagcaattctagcaactccattccgttcaggaaatgtgtattgcttcccccatcagtgtgggacatatctggggggacatgagggtctgtctgccctcccagggtctgtaggccagtggggaaaaactgatcacacatctgcatcaattctataaaaacacaggacagaaacagggaagtgctgaactgcatgctccaggaaataactttgaaggaattcgggagcaaaagatgagatgaacaaacttaatttctcctatgtatctttttttcttggcctagccagactgatgtaaaatctactagatctgtaatat

SEQ ID NO: 322795 - DNA, 972 bp, Homo sapiens
  misc_feature (5)..(5): n is a, c, g, or t
  misc_feature (910)..(911): n is a, c, g, or t
  misc_feature (914)..(914): n is a, c, g, or t
  misc_feature (921)..(921): n is a, c, g, or t
agagncggcggcacgaaaataggctaggtacgaggcgggtgtgcggtgcgcttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccgcggggggggtttcgcccttgtgtgggtcccgcaggccctttggtttggtttggggcnnctnccggatngggggcgcgcgacgcccgggggggccttccctgggcccggttgggcaccgg

SEQ ID NO: 322796 - DNA, 762 bp, Homo sapiens
tcctccaccagccagcttgagggcctcatgagaccagcggtgccccgaggtaccaacagctgttttcatagagctgcgtaggtttcaggcccatccacgggaagagccatgcccagctcctggcatgggcccagcagagcagcagtcagtgggaacggcacagtttcttaagccctcgacccccccttcacaaaggatgggtgtggtgtgtgtgttcaggggtggctcacttcctctctgtccctgccgtaggacggcaacgtccgcctgtattccatcctgggcaccacgctgaaggatgagggcaagctcctagaggccaagggccccgtgaccgacgtggcctactcccacgacggcgccttcctcgcggtgtgcgaccgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtga

SEQ ID NO: 322797 - DNA, 257 bp, Homo sapiens
  misc_feature (19)..(19): n is a, c, g, or t
gggttttttaaccaaaaanctatagtggcggtgtgtacgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtga

SEQ ID NO: 322798 - DNA, 214 bp, Homo sapiens
aattcgcggccgcgtcgactacggctgcgagaagacgaagaagggtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322799 - DNA, 297 bp, Homo sapiens
tggggcttgagctctttcagagcccagagggaagagggcagctgctgggggcacctcactggggggggcataactggaggtggtctgccttcgctcgggctaatcagctttcccagcaggtagagcggtcagcatggcaggcaggctggagcagactcctgcccctccactaagggactgcccaggatgtttttttaagctctgaaattttccagtggactaacagttcacactgatgaacagctggagctgcaagctgtgtttcatagagagcattcttgaacctagagtcaggcc

SEQ ID NO: 322800 - DNA, 3233 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322801 - DNA, 3283 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcaaaaaaaaaaaaccgatcgaccaacccacacaaaagaacaacacagacgag

SEQ ID NO: 322802 - DNA, 3573 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccccctggtgtgaaaacttgggggttaaaaatacgggaaaaataaatttttttcaaaaaaaaaaaaaaaacaacaaaaaaaaaacaaaaaaaaaagcgggggggggcccagtccacaaccacccccctggggggcccatccgcccccccccccctttatgttgtaaaaaagagggagccagctcaagatgaagactagacttattctttaactcctaagcagacgggagggcaggaccgacttaaaaaacagcacacgcgcgaacgagcgaaccacctgatagacgagtagcacattctatgagagacaaacacaccctctctattactgcgggaggaacaaaaaagataggaacaaccccaactaaacaagtaacatgagtttaagagaaacaataaaaagaatcacgcactgatttaa

SEQ ID NO: 322803 - DNA, 2813 bp, Homo sapiens
aggctaggtaggaggcgggggcgtaatcggccgagggggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322804 - DNA, 3044 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtga

SEQ ID NO: 322805 - DNA, 2833 bp, Homo sapiens
ggctccttcttgatgaggaaactgagtcttagttcgtttctgtctacggtcatagcaccctgaaagcgccggatcgcctctgatcttggaagctaagcacggtcaggcctgaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322806 - DNA, 2755 bp, Homo sapiens
  misc_feature (32)..(32): n is a, c, g, or t
gccatctgtctggcgggatgggcaggtgcccntaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322807 - DNA, 2821 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtcattctcaaggtttggtagggctgtgggtataagttatgctccacacattgcttaaaggc

SEQ ID NO: 322808 - DNA, 2906 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaatatcctttgactcaaagaggggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtga

SEQ ID NO: 322809 - DNA, 2654 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcgagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtga

SEQ ID NO: 322810 - DNA, 3206 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatgtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322811 - DNA, 2364 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagacaggtggcccggaagagttgtgggtctccttccatccagcaaacaccagctgcgctgctggccgtactgagggaccacgggggccccatgcacaggacacctgctgagctgagtgaaggcctcacttttgacatcttcacttcccccactcaccccttaaatcccacctgggaccagggtctccccctccctaagacagccacgtccagtgtataatgtgagcctcatgtggcgttgaaatttcctggtagccacatttaaaaaagaaacaggtga

SEQ ID NO: 322812 - DNA, 2333 bp, Homo sapiens
ggactgtggggaggggggctcgttgatacaggaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322813 - DNA, 1828 bp, Homo sapiens
ccgttcgtacgagaatcgctgtcctctccttgctcgagatccattgtgctctaaagccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322814 - DNA, 1485 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322815 - DNA, 1480 bp, Homo sapiens
ctgtctaaagctttcagaagaacgtgtacagacaccctgcagagacaagggtcatgactgggccctcctgcctcttgtggtggggtgggggcatgggggcgcgtcacagaaatagagaaatgacatgttccgctgcagttaaactctagtccctgattcggtccatccagaggcgggggtggggctcgtagccgggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtga

SEQ ID NO: 322816 - DNA, 1245 bp, Homo sapiens
ctcggtacccgttgtggaacgctgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtga

SEQ ID NO: 322817 - DNA, 1723 bp, Homo sapiens
tcggctaggtcagccggtgttaatcggccgaggcagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacacatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtga

SEQ ID NO: 322818 - DNA, 1088 bp, Homo sapiens
acggcgaactatactctgaagcatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtga

SEQ ID NO: 322819 - DNA, 1190 bp, Homo sapiens
  misc_feature (1128)..(1129): n is a, c, g, or t
  misc_feature (1132)..(1132): n is a, c, g, or t
  misc_feature (1139)..(1139): n is a, c, g, or t
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccgcggggggggtttcgcccttgtgtgggtcccgcaggccctttggtttggtttggggcnnctnccggatngggggcgcgcgacgcccgggggggccttccctgggcccggttgggcaccgg

SEQ ID NO: 322820 - DNA, 1079 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggattaggtgttcggtcgagcggagctgttcggttgagcggaga

SEQ ID NO: 322821 - DNA, 897 bp, Homo sapiens
tcctccaccagccagcttgagggcctcatgagaccagcggtgccccgaggtaccaacagctgttttcatagagctgcgtaggtttcaggcccatccacgggaagagccatgcccagctcctggcatgggcccagcagagcagcagtcagtgggaacggcacagtttcttaagccctcgacccccccttcacaaaggatgggtgtggtgtgtgtgttcaggggtggctcacttcctctctgtccctgccgtaggacggcaacgtccgcctgtattccatcctgggcaccacgctgaaggatgagggcaagctcctagaggccaagggccccgtgaccgacgtggcctactcccacgacggcgccttcctcgcggtgtgcgaccgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322822 - DNA, 884 bp, Homo sapiens
  misc_feature (758)..(758): n is a, c, g, or t
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaatttgacantttttcttttttataaagggtatttatatgtgggtagaatttaggtattataagagtgataaaaaattgttggcattaagggataaacgtgtttttactttttttggcattggtatgccgattatt

SEQ ID NO: 322823 - DNA, 448 bp, Homo sapiens
tcctgcccctccactaagggactgcccaggatgtttttttaagctctgaaattttccagtggactaacagttcacactgatgaacagctggagctgcaagctgtgtttcatagagagcattcttgaacctagagtcaggcctgcggcccctcatcaggcaggtaattgttttcctgcaggaccacagccgctttgtcaactgtgtgcgattctctcctgatgggaacagatttgccacagccagtgctgacggccaggtaagaactgggatgggttttggggtggggaatggcttgtctgcctgctcccgtgactgctcagagccgcaggctgcctaatgctagtcctgacatgcagaacttagacatcgccctccccacatctgcagactcgtcgtcagagcccagtaaatgcatgtctgcttttaaaccacactgggagcttagtc

SEQ ID NO: 322824 - DNA, 3098 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtga

SEQ ID NO: 322825 - DNA, 2439 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataact

SEQ ID NO: 322826 - DNA, 2679 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtga

SEQ ID NO: 322827 - DNA, 867 bp, Homo sapiens
gttcacgctgacgtcccaaatcttggaagttttgtccccatttgctttctgcttctggggacaaaacttccaagatttgggacgtcagcgtgaactccgtggtcagcacatttcccatgggctccacggttctggaccagcagctgggctgcttatggcagaaggaccacctgctcagtgtctccctgtccgggtacatcaactatctggacagaaacaaccccagcaagcccctgcacgtcatcaagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattcttctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322828 - DNA, 3640 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcaaaaaaaaaaacaaaaaacaaaaaaaaaaaaaaaaaaaaaacaaaaaaaaaaaaaaaacaacaaaaaaaaaacaaaaaaaaaagcgggggggggcccagtccacaaccacccccctggggggcccatccgcccccccccccctttatgttgtaaaaaagagggagccagctcaagatgaagactagacttattctttaactcctaagcagacgggagggcaggaccgacttaaaaaacagcacacgcgcgaacgagcgaaccacctgatagacgagtagcacattctatgagagacaaacacaccctctctattactgcgggaggaacaaaaaagataggaacaaccccaactaaacaagtaacatgagtttaagagaaacaataaaaagaatcacgcactgatttaa

SEQ ID NO: 322829 - DNA, 2864 bp, Homo sapiens
ctacaacgccaaggcgatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322830 - DNA, 3182 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322831 - DNA, 3179 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322832 - DNA, 3089 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtgaatgttcatgaacattcgtgtccaacagcccattttcagaaaatccagagccatcgattagagcgtggaaagggagaattaaagttatgttcgtatttcttctcttaaccagattatgagtcagatgttgactatatctgcagaacatttgccaagtattttcagacacctgttttgctaaaatcacagagtgacagcctcttcgtgttgcctgtggcacagaagcatattgtgtgccgcatatctgaacctggggctaaaacactcccagttctaatgcatagtctcctactttagggtggacacgaatgttacaggtagccgagg

SEQ ID NO: 322833 - DNA, 2734 bp, Homo sapiens
caacgcatgtgccgctcccaacgcatgtgccgctcccaacgcatgtgccgctcccaacgcatgtgccgctcccaacgcatgtgccgctccattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322834 - DNA, 2813 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322835 - DNA, 2819 bp, Homo sapiens
gttcttaactcattcgtcagaaggacccaggggtcagccaggcccagccatctccctggcccactgcacttcaaggaagctcaggctggcttggaggagccagtgcgaagtcagcggcaaggcgaggctgtgctggccaaggaagcggagttcggcagcgagagaactcgatgtgctggtcagaggtctaggattcgagctgtggttatgtcatggtcaaggttgtgtggcctcatctggaaggagtagtggtgcatacacccctgtccaccccccgcccaacagggggtctagaagtgctttgcctcaggccctcccaccactgccttcactgcagccggctccttcctgcagctctctcgggaactgccctgtgaggccctttgacacagggaatgtggaccctatggactgacatggacaagggaccgtgggccatgttgacacagataggaggtggaccccatcggctaaccccgacgggaacaggccctcagtgcatgacggctccctcatggaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322836 - DNA, 2318 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacacatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataact

SEQ ID NO: 322837 - DNA, 1824 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtgcgcatccggtgtgtcttcgcctggaccggccggcgcggcaggcgggccaggggacc

SEQ ID NO: 322838 - DNA, 1379 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctcccgtcatagatgtatatctggccgtcagcactggctgtggcaaatctgttcccatcaggagagaatcgcacacagttgacaaagcggctgtggacgccaactgtgaacttgaacttgaa

SEQ ID NO: 322839 - DNA, 1226 bp, Homo sapiens
  misc_feature (1087)..(1087): n is a, c, g, or t
  misc_feature (1096)..(1096): n is a, c, g, or t
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcctgatgggaacagatttgccacagccagtgctgacggccagatatacatctatgacgggagacactgagcaggcaggccttctgccataggcagcccagctgctggtccagaaccgtgntgcccatgngaaatgtgctgaccacggagttcacgctgacgtcccaaatcttggaagttttgtccccagaagcagaaagcaaaatggtgctgtcggcgactcaactaattgcgtaaattccaccggcgggggccttgct

SEQ ID NO: 322840 - DNA, 1221 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattcttctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322841 - DNA, 816 bp, Homo sapiens
caaggtggtgacggtgttaactcctgctcgaaggacaggtggtctcttcgttgggacgtcccctttgccagcagccttcttctcggcccgggccaacagtctctgcttcttctcttgctttgtctctggtctgtacttgtgggccagcttaagcagctgagtagctgtttggcggtccagggcctgggtgaactggttaatcgcaggaggcactttcagccgcttatagaggatggctctctgccgctgcaacctgatatagcggggccatttcacaaagcgggtgaggtctcttttgggctggatgtcctgtccaatgccaaaattcttaggccttttctcaaacaggggattcaccactttcttagcctcctgcttcttcacgacagctggggccggagccaccttctttcccttggccttctttcctttcgccctcttctgctctcaagagcaaaggttatgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 322842 - DNA, 849 bp, Homo sapiens
acgtcacttccggggcggggcgagcaaggcggaggcggggccggggccggcgggggaggggagcgccaggtccgcgcaggctcgccgggaccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaaattctttttcttggtaaacctaggaatcttgcttccaacccctactctgtaatgtgcatctactctgtctaatacacttgggagttcaaacggaaactt

SEQ ID NO: 322843 - DNA, 182 bp, Homo sapiens
tcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaaggtaaggcctgccctgggg

SEQ ID NO: 322844 - DNA, 598 bp, Homo sapiens
gcaggaattcggcacgaggggtgtttgttcatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322845 - DNA, 915 bp, Homo sapiens
cgacgagccgggatgttaatcggccgaggaacagacacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaacctggaagcccaatctctttattccaaaggagacccactggttaaaactcacaggggaaacg

SEQ ID NO: 322846 - DNA, 603 bp, Homo sapiens
tgctgcggtcgtctagaggatcccagacgaccttgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaagtcgtctcacggggaatcctctgagagtcaccccagcaa

SEQ ID NO: 322847 - DNA, 479 bp, Homo sapiens
gctgccgcctactactactaaattaacggccggtcgacccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322848 - DNA, 519 bp, Homo sapiens
gcaggaattcggcacgaggggtgtttgttcatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaa

SEQ ID NO: 322849 - DNA, 493 bp, Homo sapiens
acctgaaatagaaccactgcatcccagaaccatgtgggatgacttgacttagagatgctgttgtgatggagaaatgagaccacgacacgaaccaccaaacgatgcaaatcaaaccccaacacctagttctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322850 - DNA, 432 bp, Homo sapiens
cctactttaggccgagcacggtgactcaggcctgtaaatcccagcactttgagaggccgagggccggtgggtcacatgaggccaagagttcgagaccagcctggccaacatggcaaaaccccgactctactaaaaatacaaaaattagccgggcgtggtggtgagcgcctataatcccagctactcaggaggctgaggcaggaaaatcacttcagcccgggaagcagaggttgcagtgagctgagatcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaa

SEQ ID NO: 322851 - DNA, 233 bp, Homo sapiens
ggacgcgtgggtcgaccgcttcggtcgtgcgtacgtacccacagcgttcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaa

SEQ ID NO: 322852 - DNA, 209 bp, Homo sapiens
tcaagcttctaacgatgtacggggaggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaa

SEQ ID NO: 322853 - DNA, 127 bp, Homo sapiens
atttgagtgctccggctggagtctggttaatagttaatactggaattgtgttatgatgttacatttcatgtagtgattccagtaaaagaatggttgctgatgtgaaatgtttcggggccatttggac

SEQ ID NO: 322854 - DNA, 1684 bp, Homo sapiens
ttctgtgcgcgcgtggaggcccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaaaaaaaaagaaataggaaacacaagaagagccagaagagacacacagaagaggaatcaaaagaacataaagtacccatacattacaagaaacaatcagaagagaacctggggggagcccagaatcatacgacggcccacggggggacgacatgcgcagcccatcccagcagaatttggaccaaatagagcaagggcgctggccccacgcacagggggggacggtttccaggcgaagcccacaggggcatgagaggcgctgaccgcggttggtaccacaacacaggacagcgcagggggaagggaaggagccagaacagggtcgggacggggcccaggacacccggtggagagacaaagcagacctcacgcccttgtagccccggtgggcgcaagcaacacatggacgccggggacggactccacaccgagttg

SEQ ID NO: 322855 - DNA, 1153 bp, Homo sapiens
ggacgcgtgggtcgacccacgcgtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322856 - DNA, 1173 bp, Homo sapiens
ttctgtgcgcgcgtggaggcccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaa

SEQ ID NO: 322857 - DNA, 1184 bp, Homo sapiens
ttctgtgcgcgcgtggaggcccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaacctggaagcccaatctctttattccaaaggagacccactggttaaaactcacaggggaaacg

SEQ ID NO: 322858 - DNA, 962 bp, Homo sapiens
  misc_feature (2)..(2): n is a, c, g, or t
  misc_feature (6)..(6): n is a, c, g, or t
  misc_feature (21)..(21): n is a, c, g, or t
  misc_feature (23)..(23): n is a, c, g, or t
cncgtncaattcggcagactngncaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322859 - DNA, 1511 bp, Homo sapiens
tgccagcaaccattcctccatcttagttgggttttcaaaatcattcttcatactagaagacaagatctgaggccatggtgaactgtcacatcagttgcggagcacatatgggttgctagagccatgttttagacaccctctagcctaaatctgatcacagtcatctgtccccttctcttagggtctacctttccaaagttgttagggacctgggaggagaggatgatgggatggggagtcaacaggagaaaatcatgtgcaggcagaattggaatttcaacttggtccaggcaacacaattcatttataaattactttatttctctctctctctccccactgcctctcctctgagagcttctctcctagctttttatctgtctctgtctctctgttttttcctctttttatctgagagaatagtgatgtaaaaatggtcaggaattcactttttctaatgagatcctggtcaagctgatattcagaaaagtatttaggaatgtggggccgtggtgtgtttttgatctgttcacgaggtcattccttcctcgtttctctctggaatttggtattaactgctctttcccctcttttaggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322860 - DNA, 1087 bp, Homo sapiens
gggaatgggctggtggctgactaggtcgttcggccgtgcctgggctgttcttggtcgaccgccggcgagatggtgggcgtgtccgactctaattcgagtagctcgttactctaggatctaactgaataaagccacagagaatccactgcattcccgaatagacacagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322861 - DNA, 1204 bp, Homo sapiens
ttctgtgcgcgcgtggaggcccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322862 - DNA, 1218 bp, Homo sapiens
ttctgtgcgcgcgtggaggcccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgactgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322863 - DNA, 857 bp, Homo sapiens
ttctgtgcgcgcgtggaggcccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaagtcgtctcacggggaatcctctgagagtcaccccagcaa

SEQ ID NO: 322864 - DNA, 808 bp, Homo sapiens
catttgttagtgtctctgtgacgtcgttagtggaaattgccttctgctgttttccttctgctttttctgcagcatccattttttttaatgaatggcatcattcaatgaaattgattgaattgattgagatttagggttttgctttctcgtgatgagttttgggcccatttttcttatgcagaaataaaaccactggctcctgaaagttgtaggaactgtgtccacgtgagtgctcagggacctgggaatgactttcttttgtctctgtctcccacagttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322865 - DNA, 635 bp, Homo sapiens
ttctgtgcgcgcgtggaggcccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagcgtgacacaggatccgctagatcaa

SEQ ID NO: 322866 - DNA, 396 bp, Homo sapiens
gaaacggcagtgaatcgagctccggtaccctgtggagtgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322867 - DNA, 403 bp, Homo sapiens
aggtgagaaaaaacaatgctaaaaacattctccgactgtttccaagaaaatgaaacatccttaaccacaaaagagttgacacttgttttcccagctgcaacttttactaactgaaatatcttatctctttagacaatgaaaacaagaaacccactgcaatccccaagaaacccagtgctggtgagaagggcttcttcctagtatgcaaagaaaaagagcaaatcattttctcggacagcaggacgggacttaggcaactagaaagaagacagaagtgatttgagtgctccggctggagtctggttaatagttaatactggaattgtgttatgatgttacatttcatgtagtgattccagtaaaagaatggttgctgatgtgaaatgtttcggggccatttgga

SEQ ID NO: 322868 - DNA, 367 bp, Homo sapiens
tttataaattactttatttctctctctctctccccactgcctctcctctgagagcttctctcctagctttttatctgtctctgtctctctgttttttcctctttttatctgagagaatagtgatgtaaaaatggtcaggaattcactttttctaatgagatcctggtcaagctgatattcagaaaagtatttaggaatgtggggccgtggtgtgtttttgatctgttcacgaggtcattccttcctcgtttctctctggaatttggtattaactgctctttcccctcttttaggggatgactttgacttaggagatgctgttgttgatggagaaaatggtgagtattttcctttaatctcttctgct

SEQ ID NO: 322869 - DNA, 1252 bp, Homo sapiens
ttctgtgcgcgcgtggaggcccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322870 - DNA, 998 bp, Homo sapiens
tgctgcggtcgtctagaggatcccagacgaccttgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322871 - DNA, 1034 bp, Homo sapiens
tcgtcgtcgtcgtcgtcgtcgtcgtcgtcgtcgtcgtcgtggtggtttcgatttatctgatgtccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322872 - DNA, 983 bp, Homo sapiens
cgacgagccgggatgttaatcggccgaggaacagacacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322873 - DNA, 1012 bp, Homo sapiens
  misc_feature (460)..(460): n is a, c, g, or t
ttctgtgcgcgcgtggaggcccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggcttttcanatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaa

SEQ ID NO: 322874 - DNA, 742 bp, Homo sapiens
ttctgtgcgcgcgtggaggcccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctggtaagaaggacggggaacgat

SEQ ID NO: 322875 - DNA, 712 bp, Homo sapiens
ttctgtgcgcgcgtggaggcccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatggtcagctggcaggctctttgggaccttgtattgggatccgccgtgaag

SEQ ID NO: 322876 - DNA, 926 bp, Homo sapiens
gagccacccttacttcagaagaacggcatggggtgggggggccttaggtggtgcccgcctcacctatgactgccaaaagcggtcatggggttatttttaaacatggggaggaagtatttattgttcctgggctgcagagagctgggcggagtgtggaattcttctcgggaggcagtgctgggtcctttccaccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttgggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgta

SEQ ID NO: 322877 - DNA, 885 bp, Homo sapiens
  misc_feature (18)..(18): n is a, c, g, or t
  misc_feature (22)..(22): n is a, c, g, or t
  misc_feature (27)..(27): n is a, c, g, or t
ccgggctgcaggaattcngganttttntggggaggcagtgctgggtcctttccaccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttgggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggcattatcactcatttttgagctggtggtatggtactgtgggggacatctaagtgaatcatccgagcagtcaataaaggggcggttggccaattttggacaggctggtagaagaagcgatatttgaagtgggcgaaaaaaaaaaaatgtgggcgccgaagtaaatgggggcgaaaaaatagagacagaggggtaacaaggggggaaagagagaaaaggag

SEQ ID NO: 322878 - DNA, 1036 bp, Homo sapiens
gagccacccttacttcagaagaacggcatggggtgggggggccttaggtggtgcccgcctcacctatgactgccaaaagcggtcatggggttatttttaaacatggggaggaagtatttattgttcctgggctgcagagagctgggcggagtgtggaattcttctcgggaggcagtgctgggtcctttccaccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttgggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacacttgaatgcgttgagaatggttcctcaggtttccccctcccctttcatgacatgaaacgaatactacttttctgtgtgcggtctaggcatggcttggccaccaagtgggtagtcccatattgggtattgggtgatgtgtgccaaccttggggaagctcactggctataaagagggacataacagacgacagcggagggagacgggccaaaaggaagacacattggggatagaatcacccaactccaagcatttgtgttcctcaagacaggggaccaatgttctggggagagagacttgtgccaccccttatgttggattgcggaccaggaggggggatatggctcacactgctggatggttatggggcgtttaaacaaaaggagaagagcacgataagagagcagagtgccatagaaacaacaaaagaaaaaagacaagagaagaaagaggcgacgcatagggaagcgacacacaccacaggaaacag

SEQ ID NO: 322879 - DNA, 538 bp, Homo sapiens
  misc_feature (406)..(406): n is a, c, g, or t
  misc_feature (413)..(413): n is a, c, g, or t
  misc_feature (418)..(419): n is a, c, g, or t
  misc_feature (423)..(423): n is a, c, g, or t
gagccacccttacttcagaagaacggcatggggtgggggggccttaggtggtgcccgcctcacctatgactgccaaaagcggtcatggggttatttttaaacatggggaggaagtatttattgttcctgggctgcagagagctgggcggagtgtggaattcttctcgggaggcagtgctgggtcctttccaccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttggcgagtgaacgtgaaaatgagaattgatgaatgatcaggggtcnggtcatnacttnntgtntctacatgttggagacttaggagcgacctaggaccatctcacgattcaagtgttaccttagcaagggtctagctgatacgtcggaatctgacacgagcgaagttcagagagtcca

SEQ ID NO: 322880 - DNA, 517 bp, Homo sapiens
gagccacccttacttcagaagaacggcatggggtgggggggccttaggtggtgcccgcctcacctatgactgccaaaagcggtcatggggttatttttaaacatggggaggaagtatttattgttcctgggctgcagagagctgggcggagtgtggaattcttctcgggaggcagtgctgggtcctttccaccatggcacctaagaaagcaaagaagagagccgggggcgccaactccaacgtgttctccatgttcgaacagacccaaatccaggaatttaaggaggtgggtgcagctattgaatcatccgcctggatggaaatcccacccacgagggagaaccttctttttgttccatattcccagcagggacctttcattagatgcctctatcctccaaacaatcccaaattcggcctgaacggatgtgtgaatttttaaaagaaactatttttaatattttcactgattatcaaagtaaaacatattccatgttgaaaaatgttggaaaatttt

SEQ ID NO: 322881 - DNA, 1277 bp, Homo sapiens
gagccacccttacttcagaagaacggcatggggtgggggggccttaggtggtgcccgcctcacctatgactgccaaaagcggtcatggggttatttttaaacatggggaggaagtatttattgttcctgggctgcagagagctgggcggagtgtggaattcttctcgggaggcagtgctgggtcctttccaccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttgggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgtaaaaaaaaaaaaaaaaaaaaaaaaaaaaaaaaagaaaaaaaaaaaaaaaaaaaaaaaaaaaaaagggggggggcgccgcggcccccgaaaaagacttttaaaaacacccgggggggggggggggccccaagagtgaagtaagtggagccaccatgcgggcaacaagcggtgggtgccataggagagcgctgggcgaaggagccaatcgccgggggtggctctctctccccaaaagaaaaaaacccgcgcgcggggaaccccacgccgtgttgtgaaaaacacactacgaggggggcgcgagggcggcacacaggggaggcatccaccgagggggcgcacaggccgcgattat

SEQ ID NO: 322882 - DNA, 1291 bp, Homo sapiens
gagccacccttacttcagaagaacggcatggggtgggggggccttaggtggtgcccgcctcacctatgactgccaaaagcggtcatggggttatttttaaacatggggaggaagtatttattgttcctgggctgcagagagctgggcggagtgtggaattcttctcgggaggcagtgctgggtcctttccaccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttgggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgtaaaaaaaaaaaaaaaaaaaaaaaaaaaaaaaaagaaaaaaaaaaaaaaaaaaaaaaaaaaaaaaaatttggggggggcccgggcccgggaaaacgtttctaaagacaaatgggggggggggcgggggccccacaagacgaggaggaacgggggtcaagcaggggcacacaaggagaaaggggggcacacacacgggggggggatctctcaaataaaaaaaaacgccgcgcgggggggggccaacgaggggtgcttgcggagaaactcacccaagaggggggagggagcgggcgaccgagggggggcgaatcccaaagagggagccgcggagaggggcagcataaaatacaccccccgagggggggc

SEQ ID NO: 322883 - DNA, 791 bp, Homo sapiens
  misc_feature (18)..(18): n is a, c, g, or t
  misc_feature (22)..(22): n is a, c, g, or t
  misc_feature (27)..(27): n is a, c, g, or t
  misc_feature (93)..(93): n is a, c, g, or t
ccgggctgcaggaattcngganttttntggggaggcagtgctgggtcctttccaccatggcacctaagaaagcaaagaagagagccggggggngaaattccacgtgttttttaaggtgtggtgttgttgtttgttggctggttatgtgagttgtggtgttcagagttgtgtatgttgttatgggtgtgggtgtgtttgttgagtgtggtggtatcattggctgccttggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgta

SEQ ID NO: 322884 - DNA, 884 bp, Homo sapiens
gagccacccttacttcagaagaacggcatggggtgggggggccttaggtggtgcccgcctcacctatgactgccaaaagcggtcatggggttatttttaaacatggggaggaagtatttattgttcctgggctgcagagagctgggcggagtgtggaattcttctcgggaggcagtgctgggtcctttccaccatggcacctaagaaagcaaagaagagagccgggggcgccaactccaacgtgttctccatgttcgaacagacccaaatccaggaatttaaggagctcggagtccctgagtgtgtgtttcctaccctagggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgta

SEQ ID NO: 322885 - DNA, 840 bp, Homo sapiens
agctgcgctagtgtcgaaactgcttgtcgcgcaggcacctgctgggtccttgccaccgtggataacctagtaacaagcaagaaatacagcctggtggacgtcaccatagctctcgagaactgtcgttcacctccatgttatcgaagccagcaggccgaagaatccagagacgtttctggacggcctccaggaagtcatggcaccaggaacagggcatggatccatccgacaggaagtgatctgaaaagacgaaccattgctgccctctgccgcgacggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgta

SEQ ID NO: 322886 - DNA, 870 bp, Homo sapiens
  misc_feature (382)..(382): n is a, c, g, or t
  misc_feature (390)..(390): n is a, c, g, or t
gagccacccttacttcagaagaacggcatggggtgggggggccttaggtggtgcccgcctcacctatgactgccaaaagcggtcatggggttatttttaaacatggggaggaagtatttattgttcctgggctgcagagagctgggcggagtgtggaattcttctcgggaggcagtgctgggtcctttccaccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttggcgagtgaacgtgaaaaatncctcacantgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgta

SEQ ID NO: 322887 - DNA, 679 bp, Homo sapiens
gagccacccttacttcagaagaacggcatggggtgggggggccttaggtggtgcccgcctcacctatgactgccaaaagcggtcatggggttatttttaaacatggggaggaagtatttattgttcctgggctgcagagagctgggcggagtgtggaattcttctcgggaggcagtgctgggtcctttccaccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttgaaaaaaaaaaaaaaaaaaaaaaaaaaaaagggggggggcgccgcggcccccgaaaaagacttttaaaaacacccgggggggggggggggccccaagagtgaagtaagtggagccaccatgcgggcaacaagcggtgggtgccataggagagcgctgggcgaaggagccaatcgccgggggtggctctctctccccaaaagaaaaaaacccgcgcgcggggaaccccacgccgtgttgtgaaaaacacactacgaggggggcgcgagggcggcacacaggggaggcatccaccgagggggcgcacaggccgcgattat

SEQ ID NO: 322888 - DNA, 1633 bp, Homo sapiens
gagccacccttacttcagaagaacggcatggggtgggggggccttaggtggtgcccgcctcacctatgactgccaaaagcggtcatggggttatttttaaacatggggaggaagtatttattgttcctgggctgcagagagctgggcggagtgtggaattcttctcgggaggcagtgctgggtcctttccaccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttgggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgtatttggtcacgacatttctctgaaaaaaagtgccttgtgtaaggaaggcaaaggcagatgagctagtgacagccttgcagtcattattattgaatcttggtgactctttatttaaggtagaccttttgcagccactcagaactgtttctatcaaggatcacgttttcctggaatgttacctggatgaccaaagccctctcttccaaagagctcaagcatttagagggccttgcttccatgacatctgtcccttgggatgccatcggaatgcctctcctgccagtgacagtgacaagaaggaagcggactgacacatggtaggaacatagctcgttcaacagtaatcacacctgctaatcctaagagggtgacttctagtttcagataaagtagaagttgtctgtacttcttccctagcaaactgagggagtggtactgacttctgtctctgtctggggcccaggcctggatgtgagttgacctttgattttgaatgaccacagtcacggttgaagcattcaggtctgttatggctgcaagagtcccagtgtaagaaacaaatagggccaggtgtggtggctcacgcctgtgatgctagcgctttgagaggctgaggcaggaggatcacttgagcccaaaagtttgagaccagcctaggcaacatagtgagatccaatctctataaaaaataaatagccaggcatggtg

SEQ ID NO: 322889 - DNA, 857 bp, Homo sapiens
gagccacccttacttcagaagaacggcatggggtgggggggccttaggtggtgcccgcctcacctatgactgccaaaagcggtcatggggttatttttaaacatggggaggaagtatttattgttcctgggctgcagagagctgggcggagtgtggaattcttctcgggaggcagtgctgggtcctttccaccatggtgagtacaagggctccaggaggtgatgatgccgggtgggcgaggagaggaagccactacaagcgagggaccacggcggagggggaggaaggcggccctcaaagcctccagccccttgtggaaaaagccccattgactgcgcgggcacagaggaaccccaatcaatgccccgataggccacaaataacagcagctctcggggactcacaaacacaaaataagagagttggcttttttatggcttgtctactgacctctcgaggaatcaataactcccaggacttgcaaaatgggattgaatgcttttaaggatcaaattgtaattcttttctcttgttcaggcagctgggaaaaagaatgtttttgttttcaccttttgaacttgcaaatttaaaacctttctttctgtgctgttgggttaggtgtccccctcctgaagtgggcagtccccaaatcagggtcagcacaggagggagagtggttagaggcaggaactctggagtcagaatgcccaagttcaactccccaagttcaacgcccaagttcaactccggctctgccttctgtgtgtgtggctgtgtgatcttgggcaagtgacccaacctctctgagcctcagttgcctctcctgtaaaatggggatgataataatagtatccact

SEQ ID NO: 322890 - DNA, 1264 bp, Homo sapiens
  misc_feature (1264)..(1264): n is a, c, g, or t
gagccacccttacttcagaagaacggcatggggtgggggggccttaggtggtgcccgcctcacctatgactgccaaaagcggtcatggggttatttttaaacatggggaggaagtatttattgttcctgggctgcagagagctgggcggagtgtggaattcttctcgggaggcagtgctgggtcctttccaccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttgggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggcggagtgtggtatagttgtcgggacggccacagaggggtcgttccacatcatgggcgacctacgtagtaggcaggtacgtagagccgggggcgccaactccaacgtgttctccagtgtcgaacagacccaaatccaggaatttaaggaggcctttcacgtatcatggaccagaacagggatggccttcatggacaaggagcgatctggagagacacctgttgctgcccttggggcgagtgaacgcgcaaaaatgaagacatcgctgaccatgctcacgtcggtccgggccccaacaagttactgggtccccacaggggtctgggacgaagctcaagggacggaccgagaaccccccagcgggcgcacaaggtggccccagcacacgggggaacgggaaccn

SEQ ID NO: 322891 - DNA, 765 bp, Homo sapiens
tgactctttgaggatcccctgccatttactccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttgggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgta

SEQ ID NO: 322892 - DNA, 789 bp, Homo sapiens
  misc_feature (18)..(18): n is a, c, g, or t
  misc_feature (22)..(22): n is a, c, g, or t
  misc_feature (27)..(27): n is a, c, g, or t
ccgggctgcaggaattcngganttttntggggaggcagtgctgggtcctttccaccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttgggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgta

SEQ ID NO: 322893 - DNA, 696 bp, Homo sapiens
taacgactgcaagtggatctgcatgcatgggcatacctaaatccatgggtttaagggccttcactatcatggaccagaacagggatggcttcattgacaagaacgatctgagagacacctttgctgcccttgggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgta

SEQ ID NO: 322894 - DNA, 760 bp, Homo sapiens
caaccaaccaaccaacctatccacccacccactaaccaactaactaaccagccaacctactcccccatacccaccaaccaactaaccaacccaccctcccaccaaccaattaaccaggcaacccactcacacccctcccctccaacaaccaacaaaccaaccaccccctatacaaacagcttttggttgcacataaccaaagctgttgttgagtgggaagtggagattgtctaattaataatctgttttattctttttcagatcacgttgcacagggtacataaagctgaatcatctgggggaagtttgctaaagacacagaatgcaaagccccatctcactcttcttgaatcagaatggctgactgtggtgctcaggaatttgcatgtttaataagttttccccgggtgattctaatgaatgcaacttgagtactgtttagtatatgctgagtatacctggagctttgatgtgctgcagggattagaagagttttctgattttgaccttcccattttgaaataagtagattcaccattttttattatttttgggatggagtctcactctgtcgcccaggctggagtgcagcggcgcgatctctactcactcactgcaacctctgcctcctgggttcaagagattcttctgcctcagcctcctgagtagagatggagtttcgccatgctggccaggctggtctcgaactcctgacctcgtgatccacccacctcggcctcccaaagtgctaggattacaa

SEQ ID NO: 322895 - DNA, 503 bp, Homo sapiens
ttcggcacagcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgc

SEQ ID NO: 322896 - DNA, 616 bp, Homo sapiens
acgccgggtttttccaagtcagacgtttgtaaaacgcgggccggttaattgaaaaacgactcccaaaagggcgaattgggaacgggccccccctcggtcccaattcggcacgagcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgc

SEQ ID NO: 322897 - DNA, 500 bp, Homo sapiens
  misc_feature (26)..(26): n is a, c, g, or t
tccccgggctgcaggaattcggcacnagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgc

SEQ ID NO: 322898 - DNA, 558 bp, Homo sapiens
caccaggaaagccacaggaacacaatgttggaatacattgggttttgcccgcaccgtcaagctccgaattaattggggaggtgcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgc

SEQ ID NO: 322899 - DNA, 779 bp, Homo sapiens
  misc_feature (26)..(26): n is a, c, g, or t
  misc_feature (538)..(538): n is a, c, g, or t
  misc_feature (595)..(595): n is a, c, g, or t
  misc_feature (599)..(599): n is a, c, g, or t
tccccgggctgcaggaattcggcacnagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccaaaaaaaaaaaaaaaaaaaaaaaaagggggggggggntaaaattttccccgggggggcccagtttaggcgtacccagttttttgtgtacaaggnggcncccatatagaaacgccggtattaaaaagacaaagcgcagtggcgcgcggttacaaagggttgggactggtaaacttggctagctggaattttggagaggagacattacttctgggcgtggaccttattggacaccttcctagggatttaacggttcaggaatatacttcagtgatcggac

SEQ ID NO: 322900 - DNA, 1587 bp, Homo sapiens
ctgccctgtccggcagccgggtctgccgccccgtgggagagcttccgggccggcgcgggattcggcccaggcagcgccgcgcgtcccacccggagtaccccgggggactcgaggggtgctctgcggaggcccgggttgctgggggcagggccgcgagctgctgtggggcctacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgtttactgtttagataaagtgtaaaaactggcatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttat

SEQ ID NO: 322901 - DNA, 546 bp, Homo sapiens
atgggcaaggtcaagcaccctgtgactgggggagaacctttgaacctggagtgtgggcctgggttcgccccggatccctgtccattgcttgctgtgggccttggtttctttatctgtaaaatggaggtaatgcctggattacaaggctgctataaggatgagaggggacaatgagggtactttttaatgaaagcattcttgtcaccaccagggaaccatagtcaggatttgggggcatgtaggtgtcattccacagccacttaccaagcagccctctcttagcttggtgctgggactcattgcctctccaatggaattttccaagtgtgttgagggctgtcttgctccttacctacttgattctcttgcagatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgc

SEQ ID NO: 322902 - DNA, 289 bp, Homo sapiens
tcgctattcatcggcacctcgctattcatcggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttacggtgccgatgaatagcgaggtgccgatgataacgaggg

SEQ ID NO: 322903 - DNA, 486 bp, Homo sapiens
  misc_feature (378)..(378): n is a, c, g, or t
aaaaaaaaaaaaaaaaaaaaaaaaaaaaaaaaaaaaaaaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccaaaggtcacttcaggaaagctttttaaaaaaagcttgaatttttacttgaaagaaaaaacaacaccaaaaaaatncttcttgggtggggggcgcgggaacaccaatctcgccctatacgggaatcttaattacaaataacactggcccgtcgttataacaaacggcgggaactggagaaaacc

SEQ ID NO: 322904 - DNA, 538 bp, Homo sapiens
  misc_feature (26)..(27): n is a, c, g, or t
gcgcccctactactactaaattaacnnacgctcgaccttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgc

SEQ ID NO: 322905 - DNA, 1705 bp, Homo sapiens
acgccgggtttttccaagtcagacgtttgtaaaacgcgggccggttaattgaaaaacgactcccaaaagggcgaattgggaacgggccccccctcggtcccaattcggcacgagcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttat

SEQ ID NO: 322906 - DNA, 792 bp, Homo sapiens
  misc_feature (593)..(593): n is a, c, g, or t
  misc_feature (600)..(600): n is a, c, g, or t
  misc_feature (603)..(603): n is a, c, g, or t
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgaaaaaaaaaaaaaaaaaaagaaaaaacaanttttgtnggngggcctgggcccaagaaaaagtttttaaaaaccccttccggttgggccccgggcccatggtgaacggcaccctggccctggtcccaaaggaaccggggccggccttggcgggttccccaaaaaaacgccggggcaccgggttcggccaacccaggcgcggggccgggtctcccgggccagggccattac

SEQ ID NO: 322907 - DNA, 1337 bp, Homo sapiens
  misc_feature (1337)..(1337): n is a, c, g, or t
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgacaaaaaaaaaaaaaaaaaaaaaaaaaaaaaaaacaaaaaaaaaaaaaaaaaacaaaaacaaaaacaaaaaaaaaaaaaaaaaaaaaaaaaaaaaaggggggggggggggctagacctcccgggggggccaaaaattaccgccaccccaatatttaataaacacagggggcctcacagatagagtgtcatatatatatacagagcagacggggagccgtatataaaaccgtgtgtgatcggcaaaacccatgtgctcaagccatgccactcttttgagcaagccaaccttcttttgggagagccacacaaattaagggcaacacccatccaacacgaaataaaaaacacaccacaagacaaataaaacgatagatataatgatgggaacgacacactcgagagcaatctggaagacgagtgagaatatctcttcggacaacgacgtatctctagaagcaacattatacacgggcgcctcctctgtctatactaccaacacgaaccaacagcaactgaaacaacacaaacccacgcgggagtgccgaggcggggcctgagcggcgggcggacgggggtggaaagcaggcaggagccaacaagaaggccaaacgccccccggcggggcgacacacaagacgaggttagaggaggagagatgcaagaagaaaatatggagagagggacatgagaagaagcaggaggcagatgaaggagagcgaaagaggaacaaggaagagagtcgggaaaagggggaagcaaacaaaagacgaacn

SEQ ID NO: 322908 - DNA, 593 bp, Homo sapiens
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgcaaaaaaaaaagtcgacgcggccgcgaatttagtagtagtagtaggcggccgc

SEQ ID NO: 322909 - DNA, 2956 bp, Homo sapiens
acgccgggtttttccaagtcagacgtttgtaaaacgcgggccggttaattgaaaaacgactcccaaaagggcgaattgggaacgggccccccctcggtcccaattcggcacgagcttcctcggcgctgcctacggaggtggcagccatctccttctcggtaagtgttaatccgtggcaatccgcattcctgcgggattcatctggccccgtcgcccagtggtgcggaggcctccccttcagcgcggtagtgtctgtgggtattgttattgtcagcttactggagcgtgtacaggaacagaacgaagccgccgagttgatagggctttgcgtcccagagcctcctgccctccgcctgtattcagagctgcgggctgcttgtttgttccttggcggtggagggtgctagttgaggccagacttcggggtctcctgggggccgtgggacgaccaggggtggcccagcttgacagctttcagctgggatctgtggatcccagcgctcaccaatgtcggcccacgtgtattcgttcatgccatggccggcttcttccgctgcagtctctggcccgagggctgctgctgcgggaccgccaaggaaagacgagctgtaggtcggctggtccagctgcaggcagaaattctggtagtatctctgggaatatgaagatgcaactgcccccaccttgccttcgaggatatcatgggccagaaggcagagtcgttttgaatacgtggttcattgagtacccactctgggccagttgatggctgcgaagagagcagaaggggtgctgctgtaggaaatcaatggctcggaagaccacactgaggaaggtgtgagttgatactggaagatctccaggtttgaggcatcttcagaggtatatggtggttttgtgtgtgttgagggtgtggtagcgcagcagctccctagggaattagaaggttttattgaacatttaccctgtgacaggcactgcaggcattcagcgcgcagtgtcatcttcattttacaggtgaggaaaagactcaggttcaagtagatggtcaaggccagtactaccggaaggaccatctgggggttcggacactggtggggtgggatttgctgccccttgcaaattgagagtgtcttggggtcagttttgatttgctcagctgttggcattctttgggctctgagtgggtgaggtgacccttgacctcctgggatcgcatctggagagtgcctagtattctgccagcttcggaaagggagggaaagcaagcctggcagaggcacccattccattcccagcttgctccgtagctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttat

SEQ ID NO: 322910 - DNA, 2433 bp, Homo sapiens
acgccgggtttttccaagtcagacgtttgtaaaacgcgggccggttaattgaaaaacgactcccaaaagggcgaattgggaacgggccccccctcggtcccaattcggcacgagcttcctcggcgctgcctacggaggtggcagccatctccttctcggtaagtgttaatccgtggcaatccgcattcctgcgggattcatctggccccgtcgcccagtggtgcggaggcctccccttcagcgcggtagtgtctgtgggtattgttattgtcagcttactggagcgtgtacaggaacagaacgaagccgccgagttgatagggctttgcgtcccagagcctcctgccctccgcctgtattcagagctgcgggctgcttgtttgttccttggcggtggagggtgctagttgaggccagacttcggggtctcctgggggccgtgggacgaccaggggtggcccagcttgacagctttcagctgggatctgtggatcccagcgctcaccaatgtcggcccacgtgtattcgttcatgccatggccggcttcttccgctgcagtctctggcccgagggctgctgctgcgggaccgccaaggaaagacgagctgtaggtcggctggtccagctgcaggcagaaattctggtagtatctctgggaatatgaagatgcaactgcccccaccttgccttcgaggatatcatgggccagaaggcagagtcgttttgaatacgtggttcattgagtacccactctgggccagttgatggctgcgaagagagcagaaggggtgctgctgtaggaaatcaatggctcggaagaccacactgaggaaggtgtgagttgatactggaagatctccaggtttgaggcatcttcagaggtaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttat

SEQ ID NO: 322911 - DNA, 1804 bp, Homo sapiens
acgccgggtttttccaagtcagacgtttgtaaaacgcgggccggttaattgaaaaacgactcccaaaagggcgaattgggaacgggccccccctcggtcccaattcggcacgagcttcctcggcgctgcctacggaggtggcagccatctccttctcgctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttat

SEQ ID NO: 322912 - DNA, 1592 bp, Homo sapiens
ttcggcacagcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttat

SEQ ID NO: 322913 - DNA, 1647 bp, Homo sapiens
caccaggaaagccacaggaacacaatgttggaatacattgggttttgcccgcaccgtcaagctccgaattaattggggaggtgcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttat

SEQ ID NO: 322914 - DNA, 1158 bp, Homo sapiens
  misc_feature (670)..(671): n is a, c, g, or t
  misc_feature (677)..(677): n is a, c, g, or t
  misc_feature (680)..(681): n is a, c, g, or t
  misc_feature (725)..(725): n is a, c, g, or t
  misc_feature (727)..(727): n is a, c, g, or t
  misc_feature (823)..(823): n is a, c, g, or t
  misc_feature (1054)..(1054): n is a, c, g, or t
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccaaaaaaaaaaaaaaaaaaaaaaaaaaaaaaaacaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaanntttaanaannatttaaaaaaataaaatttttttttttataacctttttccccantncctttttaatttcaaaattttttttttcccccccaaattttcactttatattccaattccccccttttaaaaaccttttaaaataaaaaacccccncttttcccaaactaatacctggaaaaccccttcctttccccaatttaaacctttttaaaaaaaaccccctttccaaaattcttataaaaaaaaaaagcccccaaaattccccttttacaaaaattgcaaatttttatttaaaaattcaatttaaaccctttatattttttaaaattttacccaaaattttttaaaaaaaaatatttttttaaacccaaagacccaaccccnaaaatcttcttatattaaaaaaattacaccaaaaaccccttttttttttcccctttttaaccaaaaacccttttataactttttctcccactcctccccttttt

SEQ ID NO: 322915 - DNA, 993 bp, Homo sapiens
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccaaaaaaaaaaaaaaaaaaaaaaaaaaaaaaaacaaaaaaaaaaaaaaaaggggggggggggaaaaaaaaacccccgggggggccctttcgcccgttttttttgaaaagggggccccaagggggggggaataaaaaaaaggggacgggggggcgctaacaaaccggcgggcggcgacacaccggcccgcgggcaccttgggaagcagaccgtccccgtgggggtggccacctgcggaccccacccaagagagtaacgggcaggcaacaaaaccttgcggggttacgggcgacaccggcttgccgcgcggaacttgctcgcttatagtacctcgcagcatcaataacacacccgaccagacccgcacacaggaaagcaacccacacaacaccgacgacaacacaaccacaacccgacacacgacacacagaaccagcgaacgcacgcacacga

SEQ ID NO: 322916 - DNA, 809 bp, Homo sapiens
  misc_feature (610)..(610): n is a, c, g, or t
  misc_feature (617)..(617): n is a, c, g, or t
  misc_feature (620)..(620): n is a, c, g, or t
caccaggaaagccacaggaacacaatgttggaatacattgggttttgcccgcaccgtcaagctccgaattaattggggaggtgcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgaaaaaaaaaaaaaaaaaaagaaaaaacaanttttgtnggngggcctgggcccaagaaaaagtttttaaaaaccccttccggttgggccccgggcccatggtgaacggcaccctggccctggtcccaaaggaaccggggccggccttggcgggttccccaaaaaaacgccggggcaccgggttcggccaacccaggcgcggggccgggtctcccgggccagggccattac

SEQ ID NO: 322917 - DNA, 820 bp, Homo sapiens
  misc_feature (579)..(579): n is a, c, g, or t
  misc_feature (636)..(636): n is a, c, g, or t
  misc_feature (640)..(640): n is a, c, g, or t
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccaaaaaaaaaaaaaaaaaaaaaaaaagggggggggggntaaaattttccccgggggggcccagtttaggcgtacccagttttttgtgtacaaggnggcncccatatagaaacgccggtattaaaaagacaaagcgcagtggcgcgcggttacaaagggttgggactggtaaacttggctagctggaattttggagaggagacattacttctgggcgtggaccttattggacaccttcctagggatttaacggttcaggaatatacttcagtgatcggac

SEQ ID NO: 322918 - DNA, 769 bp, Homo sapiens
  misc_feature (570)..(570): n is a, c, g, or t
  misc_feature (577)..(577): n is a, c, g, or t
  misc_feature (580)..(580): n is a, c, g, or t
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgcaaaaaaaaaaaaaaaaaagaaaaaacaanttttgtnggngggcctgggcccaagaaaaagtttttaaaaaccccttccggttgggccccgggcccatggtgaacggcaccctggccctggtcccaaaggaaccggggccggccttggcgggttccccaaaaaaacgccggggcaccgggttcggccaacccaggcgcggggccgggtctcccgggccagggccattac

SEQ ID NO: 322919 - DNA, 1264 bp, Homo sapiens
  misc_feature (1264)..(1264): n is a, c, g, or t
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgcaacaaaaacaaaaacaaaaaaaaaaaaaaaaaaaaaaaaaaaaaaggggggggggggggctagacctcccgggggggccaaaaattaccgccaccccaatatttaataaacacagggggcctcacagatagagtgtcatatatatatacagagcagacggggagccgtatataaaaccgtgtgtgatcggcaaaacccatgtgctcaagccatgccactcttttgagcaagccaaccttcttttgggagagccacacaaattaagggcaacacccatccaacacgaaataaaaaacacaccacaagacaaataaaacgatagatataatgatgggaacgacacactcgagagcaatctggaagacgagtgagaatatctcttcggacaacgacgtatctctagaagcaacattatacacgggcgcctcctctgtctatactaccaacacgaaccaacagcaactgaaacaacacaaacccacgcgggagtgccgaggcggggcctgagcggcgggcggacgggggtggaaagcaggcaggagccaacaagaaggccaaacgccccccggcggggcgacacacaagacgaggttagaggaggagagatgcaagaagaaaatatggagagagggacatgagaagaagcaggaggcagatgaaggagagcgaaagaggaacaaggaagagagtcgggaaaagggggaagcaaacaaaagacgaacn

SEQ ID NO: 322920 - DNA, 572 bp, Homo sapiens
acgccgggtttttccaagtcagacgtttgtaaaacgcgggccggttaattgaaaaacgactcccaaaagggcgaattgggaacgggccccccctcggtcccaattcggcacgagcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccgcacgttttctgtttaaataaatgtaaaaactgc

SEQ ID NO: 322921 - DNA, 1010 bp, Homo sapiens
  misc_feature (26)..(26): n is a, c, g, or t
tccccgggctgcaggaattcggcacnagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccaaaaaaaaaaaaaaaaaaaaaaaaacaaaaaaaaaaaaaaaaaaaaaaaaaagacgcgggggacttttttgggggggggggaaaaaggaggttgttaaggggcaggggcaagtgtccgggacccccttttttttgcagggggggacaatggggagggcccccaaaaggagagggggcgaataaatttcaaaacggcgggtacccgcaaaataaacaggagagcaaaaagaaggccgaagaggcccgacacggcaccgcggagccaaaacgggggggcccacccggcaccacggcagggcggacgagacaaacgcgacccggcgacagacacagcacgccccaaccagaacaaacagcgagagacggaacacaaacagcaccacacgaccgcgaaaagcagacccgccaccaccaaagacaacagcacgcggaaccgacaccgcggacaggcaacaacacgaagagcaacgagcacccaaccccgagccacgcagccacacgcgcagacg

SEQ ID NO: 322922 - DNA, 908 bp, Homo sapiens
  misc_feature (590)..(590): n is a, c, g, or t
  misc_feature (595)..(595): n is a, c, g, or t
  misc_feature (597)..(597): n is a, c, g, or t
caccaggaaagccacaggaacacaatgttggaatacattgggttttgcccgcaccgtcaagctccgaattaattggggaggtgcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccaaaaaaaaaaaaaaaaaaaaaaaaaaaaaanaaaananaaaaaaaaaaaaaaaaaaaggggggggggggggaaaaaatttccccggggggggccatttggggccaccccgaccattttctttaacaaaagggggggccccaatagagggaggcagcataataaaaagacagacgagcgggggccgctaaaacacagcgccggcggcggaaaagctcgacggaggaacattggggaaagaaccccctccgcgcggcgacatagggggacacaccccggagtattgacgcggggaaataactcgcggtcagggtcccagcgcacgtcgggaaatgccagaattacgcaata

SEQ ID NO: 322923 - DNA, 496 bp, Homo sapiens
acgccgggtttttccaagtcagacgtttgtaaaacgcgggccggttaattgaaaaacgactcccaaaagggcgaattgggaacgggccccccctcggtcccaattcggcacgagcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtgcctttcggaaagagggcccaggtt

SEQ ID NO: 322924 - DNA, 1684 bp, Homo sapiens
gtatttgtttaatacccggtacatatctttgagttcaacctgtagtacgtgtggcttggtcacttcgtggctaaggtaagaacgtgcttgtggaagacaagtctgtggcttggtgagtctgtgtggccagcagcctctgatctgtgcagggtattaacgtgtcaggcctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttat

SEQ ID NO: 322925 - DNA, 1391 bp, Homo sapiens
aaaaaaaaaaaaaaaaaaaaaaaaaaaaaaaaaaaaaaaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttat

SEQ ID NO: 322926 - DNA, 587 bp, Homo sapiens
acgccgggtttttccaagtcagacgtttgtaaaacgcgggccggttaattgaaaaacgactcccaaaagggcgaattgggaacgggccccccctcggtcccaattcggcacgagcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaagtgagttgggtcccacctctagttttcagtgatcagaagtttgcatctgtgtgagcacttctggcaggaactctacaaactcttgggatgcattttggcggggggtgttgtacattctctgagggaatcagaagttgttccttgca

SEQ ID NO: 322927 - DNA, 1635 bp, Homo sapiens
atgggcaaggtcaagcaccctgtgactgggggagaacctttgaacctggagtgtgggcctgggttcgccccggatccctgtccattgcttgctgtgggccttggtttctttatctgtaaaatggaggtaatgcctggattacaaggctgctataaggatgagaggggacaatgagggtactttttaatgaaagcattcttgtcaccaccagggaaccatagtcaggatttgggggcatgtaggtgtcattccacagccacttaccaagcagccctctcttagcttggtgctgggactcattgcctctccaatggaattttccaagtgtgttgagggctgtcttgctccttacctacttgattctcttgcagatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttat

SEQ ID NO: 322928 - DNA, 617 bp, Homo sapiens
acgccgggtttttccaagtcagacgtttgtaaaacgcgggccggttaattgaaaaacgactcccaaaagggcgaattgggaacgggccccccctcggtcccaattcggcacgagcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggcggggtggcgccttgccccacaagtgcccttgaggcttttttgggggaagagaccccttttatgaggaatgagtttgcgtgggtaccctggccatgctgggagtcagagttcaccccctcacccctccaagctcactccccaacccccaactccgtgtggtaagcaacatggctttgatgataaacggctttactcta

SEQ ID NO: 322929 - DNA, 541 bp, Homo sapiens
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgc

SEQ ID NO: 322930 - DNA, 532 bp, Homo sapiens
  misc_feature (7)..(7): n is a, c, g, or t
  misc_feature (30)..(30): n is a, c, g, or t
aaaaatnggctaggtacgaggccggtggtncttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgc

SEQ ID NO: 322931 - DNA, 787 bp, Homo sapiens
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccaaaaaataaatataaaattctaactttcttatctgcctacactaaatcaaatctttcaaattcataacattcttatatataaaaacctcgaggtgggcccggcaccaatttgcctatgtgagtcgattacattaattgccgtcgtttacaacgttggactggaaaaccgttggtacccaattaaacgcttgaagaataccccttctccagctggggaaaagcaaaagccgtacggaggcctttca

SEQ ID NO: 322932 - DNA, 310 bp, Homo sapiens
  misc_feature (26)..(27): n is a, c, g, or t
gcgcccctactactactaaattaacnnacgctcgactggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgc

SEQ ID NO: 322933 - DNA, 437 bp, Homo sapiens
cttaggttttgcttgggaaactcaacttcttttcctctggagacggggcatctcactctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatgagttccgagatgacccaactggccatcagagtcaccaaccccaatgccaggctgcgcagtgaagaaaatgagtaggcagctcatgtgcacgttttctgtttaaataaatgtaaaaactgc

SEQ ID NO: 322934 - DNA, 1630 bp, Homo sapiens
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttat

SEQ ID NO: 322935 - DNA, 760 bp, Homo sapiens
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgacaaaaaaaaaaaaaaaaaaaaaaaaattgggggcattaaggggggggggggaaaagggggaaaggacaggggccaagggcgcaaacgggagtcccgggacccagtttcttggcacaagggggcaaactcggcgagtccccaatagggagccgaataactcgaaaaacccggtaccggatagaaacccccaaaaagt

SEQ ID NO: 322936 - DNA, 616 bp, Homo sapiens
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgaaaaaaaaaaagtcgacgcggccgcgaatttagtagtagtagtaggcggccgc

SEQ ID NO: 322937 - DNA, 1314 bp, Homo sapiens
  misc_feature (1314)..(1314): n is a, c, g, or t
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccaaaaaaaaaaaaaaaaaaaaaaaaaaaaaaaacaaaaaaaaaaaaaaaaaacaaaaacaaaaacaaaaaaaaaaaaaaaaaaaaaaaaaaaaaaggggggggggggggctagacctcccgggggggccaaaaattaccgccaccccaatatttaataaacacagggggcctcacagatagagtgtcatatatatatacagagcagacggggagccgtatataaaaccgtgtgtgatcggcaaaacccatgtgctcaagccatgccactcttttgagcaagccaaccttcttttgggagagccacacaaattaagggcaacacccatccaacacgaaataaaaaacacaccacaagacaaataaaacgatagatataatgatgggaacgacacactcgagagcaatctggaagacgagtgagaatatctcttcggacaacgacgtatctctagaagcaacattatacacgggcgcctcctctgtctatactaccaacacgaaccaacagcaactgaaacaacacaaacccacgcgggagtgccgaggcggggcctgagcggcgggcggacgggggtggaaagcaggcaggagccaacaagaaggccaaacgccccccggcggggcgacacacaagacgaggttagaggaggagagatgcaagaagaaaatatggagagagggacatgagaagaagcaggaggcagatgaaggagagcgaaagaggaacaaggaagagagtcgggaaaagggggaagcaaacaaaagacgaacn

SEQ ID NO: 322938 - DNA, 1867 bp, Homo sapiens
acgccgggtttttccaagtcagacgtttgtaaaacgcgggccggttaattgaaaaacgactcccaaaagggcgaattgggaacgggccccccctcggtcccaattcggcacgagcttcctcggcgctgcctacggaggtggcagccatctccttctcggtaagtgttaatccgtggcaatccgcattcctgcgggattcatctggccccgtcgcccagtggtgcggaggcctccccttcagcgcggtagtgtctgtgggtattgttattgtcagcttactggagcgtgtacaggaacagaacgaagccgccgagttgatagggctttgcgtcccagagcctcctgccctccgcctgtattcagagctgcgggctgcttgtttgttccttggcggtggagggtgctagttgaggccagacttcggggtctcctgggggccgtgggacgaccaggggtggcccagcttgacagctttcagctgggatctgtggatcccagcgctcaccaatgtcggcccacgtgtattcgttcatgccatggccggcttcttccgctgcagtctctggcccgagggctgctgctgcgggaccgccaaggaaagacgagctgtaggtcggctggtccagctgcaggcagaaattctggtagtatctctgggaatatgaagatgcaactgcccccaccttgccttcgaggatatcatgggccagaaggcagagtcgttttgaatacgtggttcattgagtacccactctgggccagttgatggctgcgaagagagcagaaggggtgctgctgtaggaaatcaatggctcggaagaccacactgaggaaggtgtgagttgatactggaagatctccaggtttgaggcatcttcagaggtatatggtggttttgtgtgtgttgagggtgtggtagcgcagcagctccctagggaattagaaggttttattgaacatttaccctgtgacaggcactgcaggcattcagcgcgcagtgtcatcttcattttacaggtgaggaaaagactcaggttcaagtagatggtcaaggccagtactaccggaaggaccatctgggggttcggacactggtggggtgggatttgctgccccttgcaaattgagagtgtcttggggtcagttttgatttgctcagctgttggcattctttgggctctgagtgggtgaggtgacccttgacctcctgggatcgcatctggagagtgcctagtattctgccagcttcggaaagggagggaaagcaagcctggcagaggcacccattccattcccagcttgctccgtagctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgc

SEQ ID NO: 322939 - DNA, 1305 bp, Homo sapiens
  misc_feature (7)..(7): n is a, c, g, or t
  misc_feature (30)..(30): n is a, c, g, or t
  misc_feature (1305)..(1305): n is a, c, g, or t
aaaaatnggctaggtacgaggccggtggtncttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccaaaaaaaaaaaaaaaaaaaaaaaaaaaaaaaacaaaaaaaaaaaaaaaaaacaaaaacaaaaacaaaaaaaaaaaaaaaaaaaaaaaaaaaaaaggggggggggggggctagacctcccgggggggccaaaaattaccgccaccccaatatttaataaacacagggggcctcacagatagagtgtcatatatatatacagagcagacggggagccgtatataaaaccgtgtgtgatcggcaaaacccatgtgctcaagccatgccactcttttgagcaagccaaccttcttttgggagagccacacaaattaagggcaacacccatccaacacgaaataaaaaacacaccacaagacaaataaaacgatagatataatgatgggaacgacacactcgagagcaatctggaagacgagtgagaatatctcttcggacaacgacgtatctctagaagcaacattatacacgggcgcctcctctgtctatactaccaacacgaaccaacagcaactgaaacaacacaaacccacgcgggagtgccgaggcggggcctgagcggcgggcggacgggggtggaaagcaggcaggagccaacaagaaggccaaacgccccccggcggggcgacacacaagacgaggttagaggaggagagatgcaagaagaaaatatggagagagggacatgagaagaagcaggaggcagatgaaggagagcgaaagaggaacaaggaagagagtcgggaaaagggggaagcaaacaaaagacgaacn

SEQ ID NO: 322940 - DNA, 1132 bp, Homo sapiens
  misc_feature (644)..(645): n is a, c, g, or t
  misc_feature (651)..(651): n is a, c, g, or t
  misc_feature (654)..(655): n is a, c, g, or t
  misc_feature (699)..(699): n is a, c, g, or t
  misc_feature (701)..(701): n is a, c, g, or t
  misc_feature (797)..(797): n is a, c, g, or t
  misc_feature (1028)..(1028): n is a, c, g, or t
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaanntttaanaannatttaaaaaaataaaatttttttttttataacctttttccccantncctttttaatttcaaaattttttttttcccccccaaattttcactttatattccaattccccccttttaaaaaccttttaaaataaaaaacccccncttttcccaaactaatacctggaaaaccccttcctttccccaatttaaacctttttaaaaaaaaccccctttccaaaattcttataaaaaaaaaaagcccccaaaattccccttttacaaaaattgcaaatttttatttaaaaattcaatttaaaccctttatattttttaaaattttacccaaaattttttaaaaaaaaatatttttttaaacccaaagacccaaccccnaaaatcttcttatattaaaaaaattacaccaaaaaccccttttttttttcccctttttaaccaaaaacccttttataactttttctcccactcctccccttttt

SEQ ID NO: 322941 - DNA, 1051 bp, Homo sapiens
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccaaaaaaaaaaaaaaaaaaaaaaaaacaaaaaaaaaaaaaaaaaaaaaaaaaagacgcgggggacttttttgggggggggggaaaaaggaggttgttaaggggcaggggcaagtgtccgggacccccttttttttgcagggggggacaatggggagggcccccaaaaggagagggggcgaataaatttcaaaacggcgggtacccgcaaaataaacaggagagcaaaaagaaggccgaagaggcccgacacggcaccgcggagccaaaacgggggggcccacccggcaccacggcagggcggacgagacaaacgcgacccggcgacagacacagcacgccccaaccagaacaaacagcgagagacggaacacaaacagcaccacacgaccgcgaaaagcagacccgccaccaccaaagacaacagcacgcggaaccgacaccgcggacaggcaacaacacgaagagcaacgagcacccaaccccgagccacgcagccacacgcgcagacg

SEQ ID NO: 322942 - DNA, 949 bp, Homo sapiens
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccaaaaaaaaaaaaaaaaaaaaaaaaaaaaaaaaaaaacccgcggggacaaatattcggggggggcggaaaaaaggggaaaaaaaggggcccggggccaaaggggaacccggagccccaatttttgggtaacagggggcgcaaacatctcgcgcggggacccccaaaagaggagagcgcgagcaaaattcccggaaaacccagggtacccgggtaagaacaccagcacacaacccccaaaacaaaaccacgcagaaaaaacgggaaacacaaagaacacaggaaagaaaaaaaagaaagaaacaacacaccaacggggaaagcaaacgggcagaaaaacccaaaaaaaacacagacaccccccgcggagacaaaaacgacaccaacaagacccacacaaccaccacaac

SEQ ID NO: 322943 - DNA, 840 bp, Homo sapiens
tacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccctagtataacaaaaactaatcgtcaagacagatatacttgttagggcccggttgggccctaaagaaagatttttaaaagactcacggtacggcggcgagcgggccctgagaggacctgtcgaccttgcgccagaacccggctccaaaagagaacccccgggcacagacggagcgcgcgaatctcccccgttgaaaaaacgccccggggaacccgacgctgctgaacaaccacaaaaggggtccggagagccacacacgggacaccacacaccagggtcccaggagctccaatcattca

SEQ ID NO: 322944 - DNA, 1484 bp, Homo sapiens
  misc_feature (26)..(27): n is a, c, g, or t
gcgcccctactactactaaattaacnnacgctcgacagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttat

SEQ ID NO: 322945 - DNA, 1544 bp, Homo sapiens
tcaggggcgcgccccggcgcgccgccggggcgggccgccccgccccggggcgcccgccgccgcgaggcccgcgccaccggcgccggcgccgacgccgccgcggcgccgcggcggcacccgggggccgccgcagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttat

SEQ ID NO: 322946 - DNA, 1637 bp, Homo sapiens
acgccgggtttttccaagtcagacgtttgtaaaacgcgggccggttaattgaaaaacgactcccaaaagggcgaattgggaacgggccccccctcggtcccaattcggcacgagcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttat

SEQ ID NO: 322947 - DNA, 1747 bp, Homo sapiens
acgccgggtttttccaagtcagacgtttgtaaaacgcgggccggttaattgaaaaacgactcccaaaagggcgaattgggaacgggccccccctcggtcccaattcggcacgagcttcctcggcgctgcctacggaggtggcagccatctccttctcggtaagtgttaatccgtggcaatccgcattcctgcgggattcatctggccccgtcgcccagtggtgcggaggcctccccttcagcgcggtagtgtctgtgggtattgttattgtcagcttactggagcgtgtacaggaacagaacgaagccgccgagttgatagggctttgcgtcccagagcctcctgccctccgcctgtattcagagctgcgggctgcttgtttgttccttggcggtggagggtgctagttgaggccagacttcggggtctcctgggggccgtgggacgaccaggggtggcccagcttgacagctttcagctgggatctgtggatcccagcgctcaccaatgtcggcccacgtgtattcgttcatgccatggccggcttcttccgctgcagtctctggcccgagggctgctgctgcgggaccgccaaggaaagacgagctgtaggtcggctggtccagctgcaggcagaaattctggtagtatctctgggaatatgaagatgcaactgcccccaccttgccttcgaggatatcatgggccagaaggcagagtcgttttgaatacgtggttcattgagtacccactctgggccagttgatggctgcgaagagagcagaaggggtgctgctgtaggaaatcaatggctcggaagaccacactgaggaaggtgtgagttgatactggaagatctccaggtttgaggcatcttcagaggtatatggtggttttgtgtgtgttgagggtgtggtagcgcagcagctccctagggaattagaaggttttattgaacatttaccctgtgacaggcactgcaggcattcagcgcgcagtgtcatcttcattttacaggtgaggaaaagactcaggttcaagtagatggtcaaggccagtactaccggaaggaccatctgggggttcggacactggtggggtgggatttgctgccccttgcaaattgagagtgtcttggggtcagttttgatttgctcagctgttggcattctttgggctctgagtgggtgaggtgacccttgacctcctgggatcgcatctggagagtgcctagtattctgccagcttcggaaagggagggaaagcaagcctggcagaggcacccattccattcccagcttgctccgtagctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtgcctttcggaaagagggcccaggtt

SEQ ID NO: 322948 - DNA, 457 bp, Homo sapiens
ataccagagaacagatggcttggcagggcctagcttccatccttgctttgtaacagttcaggagatcctgcctggctgtggccctgggaggccttctgtagtacttaagatattagttttagtattttggttaattttaggtgtagataatgctgtttcaccattttcgtctaaattcatccaattgaaaactaaaaacatttctatctgattaaacccttgatgactatattcttgtattctttatctgttagccaaactcatgtgcttggaatatgcagccgttcttttggctaaatttcactgggatagacttttttgaggcagggtctctctctgttgcccaggctggagtgcagtggcatgatcatggcttactgcggcctcaacttccagggctcaagcaatcctcctgccttagccttctgagtagctgggagactataggtgtgcacca

SEQ ID NO: 322949 - DNA, 7695 bp, Homo sapiens
  misc_feature (1)..(1): n is a, c, g, or t
  misc_feature (4)..(7): n is a, c, g, or t
  misc_feature (10)..(10): n is a, c, g, or t
ngcnnnngcngttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctctccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcacttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagactaagagccagtgcctttctgtcgagcagtcaaccatctttatgctttctcagacttccagcagcctgagtttctgatggaacaagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccgtcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctccgcccgcctcccgcactgcagctccgcccgccgggctctgcgtctccacgtcccctcgtcccatccccacgtcccctcatcccgtcacctcgtccccacatccccttgccccgtcacctcgtcctcatgtccccttgtcctgtcacctcgtccccacgtcccctcgtctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacatgtacacatgcacatgtacgcaccacaaacacatgcgcaggctcctgcaggcgtgaatacacacatgcacacacatatacacacacgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaaccaatctaacatttcagtaaagtttattttgtatgcttctgtttttaacttttatttctgtagataaactgactggataatattatattggacttttctctagattatctaagcaggagacctgaatctgcttgcaataaagaataaaagtctgcttcagtttctttataaagaaactcacacaagtg

SEQ ID NO: 322950 - DNA, 7381 bp, Homo sapiens
  misc_feature (1)..(1): n is a, c, g, or t
  misc_feature (4)..(7): n is a, c, g, or t
  misc_feature (10)..(10): n is a, c, g, or t
ngcnnnngcngttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctctccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcacttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagactaagagccagtgcctttctgtcgagcagtcaaccatctttatgctttctcagacttccagcagcctgagtttctgatggaacaagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccgtcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctccgcccgcctcccgcactgcagctccgcccgccgggctctgcgtctccacgtcccctcgtcccatccccacgtcccctcatcccgtcacctcgtccccacatccccttgccccgtcacctcgtcctcatgtccccttgtcctgtcacctcgtccccacgtcccctcgtctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacatgtacacatgcacatgtacgcaccacaaacacatgcgcaggctcctgcaggcgtgaatacacacatgcacacacatatacacacacgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaacc

SEQ ID NO: 322951 - DNA, 7482 bp, Homo sapiens
  misc_feature (1)..(1): n is a, c, g, or t
  misc_feature (4)..(7): n is a, c, g, or t
  misc_feature (10)..(10): n is a, c, g, or t
ngcnnnngcngttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctctccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcacttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccgtcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctccgcccgcctcccgcactgcagctccgcccgccgggctctgcgtctccacgtcccctcgtcccatccccacgtcccctcatcccgtcacctcgtccccacatccccttgccccgtcacctcgtcctcatgtccccttgtcctgtcacctcgtccccacgtcccctcgtctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacatgtacacatgcacatgtacgcaccacaaacacatgcgcaggctcctgcaggcgtgaatacacacatgcacacacatatacacacacgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaacc

SEQ ID NO: 322952 - DNA, 7300 bp, Homo sapiens
  misc_feature (1)..(1): n is a, c, g, or t
  misc_feature (4)..(7): n is a, c, g, or t
  misc_feature (10)..(10): n is a, c, g, or t
ngcnnnngcngttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctctccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcacttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccgtcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctccgcccgcctcccgcactgcagctccgcccgccgggctctgcgtctccacgtcccctcgtcccatccccacgtcccctcatcccgtcacctcgtccccacatccccttgccccgtcacctcgtcctcatgtccccttgtcctgtcacctcgtccccacgtcccctcgtctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacatgtacacatgcacatgtacgcaccacaaacacatgcgcaggctcctgcaggcgtgaatacacacatgcacacacatatacacacacgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaacc

SEQ ID NO: 322953 - DNA, 7609 bp, Homo sapiens
  misc_feature (1)..(1): n is a, c, g, or t
  misc_feature (4)..(7): n is a, c, g, or t
  misc_feature (10)..(10): n is a, c, g, or t
ngcnnnngcngttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctctccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcacttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccgtcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctccgcccgcctcccgcactgcagctccgcccgccgggctctgcgtctccacgtcccctcgtcccatccccacgtcccctcatcccgtcacctcgtccccacatccccttgccccgtcacctcgtcctcatgtccccttgtcctgtcacctcgtccccacgtcccctcgtctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacatgtacacatgcacatgtacgcaccacaaacacatgcgcaggctcctgcaggcgtgaatacacacatgcacacacatatacacacacgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaaccaatctaacatttcagtaaagtttattttgtatgcttctgtttttaacttttatttctgtagataaactgactggataatattatattggacttttctctagattatctaagcaggagacctgaatctgcttgcaataaagaataaaagtctgcttcagtttctttataaagaaactcacacaagtg

SEQ ID NO: 322954 - DNA, 4638 bp, Homo sapiens
  misc_feature (1)..(1): n is a, c, g, or t
  misc_feature (4)..(7): n is a, c, g, or t
  misc_feature (10)..(10): n is a, c, g, or t
ngcnnnngcngttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctctccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcacttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccgtcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctccgcccgcctcccgcactgcagctccgcccgccgggctctgcgtctccacgtcccctcgtcccatccccacgtcccctcatcccgtcacctcgtccccacatccccttgccccgtcacctcgtcctcatgtccccttgtcctgtcacctcgtccccacgtcccctcgtctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggttttcaacattagacgtcaaagcgaactactatactccatggatcccataacttgaccaacggaaccagttcctagggataaggcatccatccgagcctttacatggttcgac

SEQ ID NO: 322955 - DNA, 3466 bp, Homo sapiens
  misc_feature (1)..(1): n is a, c, g, or t
  misc_feature (4)..(7): n is a, c, g, or t
  misc_feature (10)..(10): n is a, c, g, or t
ngcnnnngcngttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctctccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcacttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccgtcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcttggtggggaatcactagtgaattcgc

SEQ ID NO: 322956 - DNA, 1669 bp, Homo sapiens
  misc_feature (1)..(1): n is a, c, g, or t
  misc_feature (4)..(7): n is a, c, g, or t
  misc_feature (10)..(10): n is a, c, g, or t
ngcnnnngcngttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctctccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcaggtgctgcccgcccgtcctcgatagctggtggtcagggcgtccaaaacactgaaaaccttccgttaggtctcaccgcctcagattgttaaacaatctagcagggtaccacctgttaaaaatagaagcaaccgtgatagagatttaaaacgcagatcttgttttgcttgtcgggccagcttctgtgattagtgggtgatgaccagtcagatgtatgacccttccagatgcagtggccaggacagctgccctggctgacttctgtt

SEQ ID NO: 322957 - DNA, 395 bp, Homo sapiens
cctgaaaccctccccaggtagtgagtcccacctacacacaaaaccgccaggcttgtcagacgtcagtgacacaagacagccctttacttctcacatgtttgatccatgtttatctctctgctgttaggaagtgtttcgctgtgaaacactagttcagaccttcagaagctgcttcagtacttcgtggtgagatcatgagccacagtgtggagtgttttgattttgaggggctacgatattttgacagctttgcaagtttctgcagttccttatttggattcctgggtcagcactgacttttctctatgctgtgtttggttttgcctccctcaggctgcaggagaaagctgcagacaccatcgaggccctgcagaaggccgggatcaaagtctggg

SEQ ID NO: 322958 - DNA, 473 bp, Homo sapiens
cgtccctgccctgtgtgtggtgtgcagaaagcatttcttcagctccttcacctccgtcttctaggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataaggtaggagggtcgccgctccccctcacggtgttagcaacaggtcacgcacagggtggcacgacccttgtctgagccacttgatgccacaagaggtcattgatctccgaggagcagcaactgtcagaaaggaaggggtgaatctgattgcagtcatctcttgcttagctgtgactttgctttttacagtttccattacctacagtcaacccatgcccaaaaatatcaaacgcaaaattgcagaaataaacagttcctcaggttta

SEQ ID NO: 322959 - DNA, 453 bp, Homo sapiens
tgaagtttgtgctgatagaatgggatgagtcagtgttaggctttttgccagctgtgactttcatcctgaaatcacagttgatatcacagaccctagtttatattgttaagctttgaaaagcgctctggtctttctatgcatttcagaaagaaaatatatttaatcaaaagatccaaaaagtttgtaacaatgcactgaggtgccacttcttgtgactttcctcttacagactttgtacgacaccgcgtatctgaccctctacaacatcagcttcacctccctccccatcctcctgtacagcctcatggagcagcatgttggcattgacgtgctcaagagagacccgaccctgtacaggtaccatcctccaaacagcctctcctgagagcagagagagtaactaggcagcactctggcagttccttccaatagccacctggcagacctcagttg

SEQ ID NO: 322960 - DNA, 643 bp, Homo sapiens
cgtcaggggtgtgccttgtgttctctgttcgttgctttcagaagcagcagcatgtggcagcatctctgtgcctatgacgatattgcagtgaatatgagagagaaaatatctgagcaaaagttagccaaggacatgagtgggtagtgaaatgctggttgtgatgaacatgccacatttgtggccagagcacaaacttgatgtttactggccgtgcacatcttatcccatgaagacaacgtccagggatggccaccccagagcctgggggaggtgccgggccctgattctcgaggacacacgctgtgcacctttctcctcaccagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcaggtcagtacagagctcgattgcgctgacttagctgcttaggaataaagcctcccaagcccatatgatgattttgccaaagcagaattcagtgcagcccatgcagcttcccagcggggtccatcaccacctgcgcagtaattcagtgcaggccacgcagcttcccagcggggtccatcaccacatg

SEQ ID NO: 322961 - DNA, 771 bp, Homo sapiens
ccctcaggacgagggtgtgtcctgagttgagtctagcagttcctgcaggaggcgatggtagtgagtgcatcccagagtggctcaggtcaccccaggcagccccgtgggtatccctgagactgaccatgtgtctcgttctctcagcagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccgtcattggcctttgctgtcactgggagagaagagccgtccagggacccatggtggcccacatgtggatgccacatgctgctgtttcctgcttgcccggccaccacccatgccctccatagggtgagg

SEQ ID NO: 322962 - DNA, 7509 bp, Homo sapiens
  misc_feature (1)..(1): n is a, c, g, or t
  misc_feature (4)..(7): n is a, c, g, or t
  misc_feature (10)..(10): n is a, c, g, or t
ngcnnnngcngttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctctccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcacttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagactaagagccagtgcctttctgtcgagcagtcaaccatctttatgctttctcagacttccagcagcctgagtttctgatggaacaagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccgtcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctccgcccgcctcccgcactgcagctccgcccgccgggctctgcgtctccacgtcccctcgtcccatccccacgtcccctcatcccgtcacctcgtccccacatccccttgccccgtcacctcgtcctcatgtccccttgtcctgtcacctcgtccccacgtcccctcgtctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacatgtacacatgcacatgtacgcaccacaaacacatgcgcaggctcctgcaggcgtgaatacacacatgcacacacatatacacacacgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaacc

SEQ ID NO: 322963 - DNA, 7602 bp, Homo sapiens
  misc_feature (1)..(1): n is a, c, g, or t
  misc_feature (4)..(7): n is a, c, g, or t
  misc_feature (10)..(10): n is a, c, g, or t
ngcnnnngcngttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctctccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcacttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccgtcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctccgcccgcctcccgcactgcagctccgcccgccgggctctgcgtctccacgtcccctcgtcccatccccacgtcccctcatcccgtcacctcgtccccacatccccttgccccgtcacctcgtcctcatgtccccttgtcctgtcacctcgtccccacgtcccctcgtctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacaggttaataaattatcaatttgtaattcagcatgttggtcagagacacggtcactgattcacacccagtccctgccacagaccgtctcagacacgcacagtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttgcacacaggatcactcacatatgtacatgtacccaccacaaacgtgcaagctcctgcacacatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacatgtacacatgcacatgtacgcaccacaaacacattgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaaccaatctaacatttcagtaaagtttattttgtatgcttctgtttttaacttttatttctgtagataaactgactggataatattatattggacttttctctagattatctaagcaggagacctgaatctgcttgcaataaagaataaaagtctgcttcagtttctttataaagaaactcacacaagtg

SEQ ID NO: 322964 - DNA, 7319 bp, Homo sapiens
  misc_feature (1)..(1): n is a, c, g, or t
  misc_feature (4)..(7): n is a, c, g, or t
  misc_feature (10)..(10): n is a, c, g, or t
ngcnnnngcngttcctcaaggcattcacggacttcctggccttcatggtcctctttaactacatcatccctgtgtccatgtacgtcacggtcgagatgcagaagttcctcggctcttacttcatcacctgggacgaagacatgtttgacgaggagactggcgaggggcctctggtgaacacgtcggacctcaatgaagagctgggacaggtggagtacatcttcacagacaagaccggcaccctcacggaaaacaacatggagttcaaggagtgctgcatcgaaggccatgtctacgtgccccacgtcatctgcaacgggcaggtcctcccagagtcgtcaggaatcgacatgattgactcgtcccccagcgtcaacgggagggagcgcgaggagctgtttttccgggccctctgtctctgccacaccgtccaggtgaaagacgatgacagcgtagacggccccaggaaatcgccggacggggggaaatcctgtgtgtacatctcatcctcgcccgacgaggtggcgctggtcgaaggtgtccagagacttggctttacctacctaaggctgaaggacaattacatggagatattaaacagggagaaccacatcgaaaggtttgaattgctggaaattttgagttttgactcagtcagaaggagaatgagtgtaattgtaaaatctgctacaggagaaatttatctgttttgcaaaggagcagattcttcgatattcccccgagtgatagaaggcaaagttgaccagatccgagccagagtggagcgtaacgcagtggaggggctccgaactttgtgtgttgcttataaaaggctgatccaagaagaatatgaaggcatttgtaagctgctgcaggctgccaaagtggcccttcaagatcgagagaaaaagttagcagaagcctatgagcaaatagagaaagatcttactctgcttggtgctacagctgttgaggaccggctgcaggagaaagctgcagacaccatcgaggccctgcagaaggccgggatcaaagtctgggttctcacgggagacaagatggagacggccgcggccacgtgctacgcctgcaagctcttccgcaggaacacgcagctgctggagctgaccaccaagaggatcgaggagcagagcctgcacgacgtcctgttcgagctgagcaagacggtcctgcgccacagcgggagcctgaccagagacaacctctccggactttcagcagatatgcaggactacggtttaattatcgacggagctgcactgtctctgataatgaagcctcgagaagacgggagttccggcaactacagggagctcttcctggaaatctgccggagctgcagcgcggtgctctgctgccgcatggcgcccttgcagaaggctcagattgttaaattaatcaaattttcaaaagagcacccaatcacgttagcaattggcgatggtgcaaatgatgtcagcatgattctggaagcgcacgtgggcataggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataagaacgtctgcttcatcttccctcagtttttataccagttcttctgtgggttttcacaacagactttgtacgacaccgcgtatctgaccctctacaacatcagcttcacctccctccccatcctcctgtacagcctcatggagcagcatgttggcattgacgtgctcaagagagacccgaccctgtacagggacgtcgccaagaatgccctgctgcgctggcgcgtgttcatctactggacgctcctgggactgtttgacgcactggtgttcttctttggtgcttatttcgtgtttgaaaatacaactgtgacaagcaacgggcagatatttggaaactggacgtttggaacgctggtattcaccgtgatggtgttcacagttacactaaagcttgcattggacacacactactggacttggatcaaccattttgtcatctgggggtcgctgctgttctacgttgtcttttcacttctctggggaggagtgatctggccgttcctcaactaccagaggatgtactacgtgttcatccagatgctgtccagcgggcccgcctggctggccatcgtgctgctggtgaccatcagcctccttcccgacgtcctcaagaaagtcctgtgccggcagctgtggccaacagcaacagagagagtccagaatgggtgcgcacagcctcgggaccgcgactcagaattcacccctcttgcctctctgcagagcccaggctaccagagcacctgtccctcggccgcctggtacagctcccactctcagcaggtgacactcgcggcctggaaggagaaggtgtccacggagcccccacccatcctcggcggttcccatcaccactgcagttccatcccaagtcacagctgccctaggtcccgtgtgggaatgctcgtgtgatggatggtcctaagcctgtggagactgtgcacgtgcctcttcctggcccccagcaggcaaggaggggggtcacaggccttgccctcgagcatggcaccctggccgcctggacccagcactgtggttgttgagccacaccagtggcctctgggcattcggctcaacgcaggagggacattctgctggcccaccctgcgcgctgtcatgcagaggccattcccccaggcctgtgtcttcacccacctgccgtcattggcctttgctgtcactgggagagaagagccgtccagggacccatggtggcccacatgtggatgccacatgctgctgtttcctgcttgcccggccaccacccatgccctccatagggtgaggtggagccatggtggtgcgtcctttactcaacaaccctccaatccggatgctgtgggaagggccgggtcactcggataccatcatccctgcggatgcaccgccgtaccctgctcatctgggagtggtttccctgcggttacgtccaagcccgcctgccctgtgtgttggggctggctgagtttcggtctccccatcaccggccgcctcgtggagaaggcagtgccacgtgggaggacaaggccacgccggcagcttccagccctgccgcagaagtgccaggatgtccatcagccactcgccagggcacggagccgtcagtccactgttacgggagaatgttgatttcgcgggtgcgagggccgggagacagatacttggctgtgatgagcagacatcctctgtccccgtggaggggtcaacaccaaggtggtgttcgtgcaccagaacctgtctcgggctgacgggggtggcacacaggacacgggtggatcccaacaggcagcaccgcacctccgcccgcctcccgcactgcagctccgcccgccgggctctgcgtctccacgtcccctcgtcccatccccacgtcccctcatcccgtcacctcgtccccacatccccttgccccgtcacctcgtcctcatgtccccttgtcctgtcacctcgtccccacgtcccctcgtctcatccccacgtcctctcgtccccttgtcccgtccccacataccctcgtccccatgtccccacgcagggctctccttcgtcttaggatctgtccagcgctgctctgggtgggttagcaaccccagggctgctgtgataggaagtccctgttgttctccgtactggcatttctatttctagaaataatatttgacatagccttaatggtccttaaagaagacatttcagtgtgagattcagacttcagacgctgaaactgctgcctttcaggaaagcaccaccaacgctggaggaggagccggccctcacgcccgccccgcgccacgctgtggaacggggctccggcaagtgaaacccagagggtgtttccgaggtgctcgacagtaggtatttttggaagctcagatttcaccatttgattgtataatcttttacctataaaatatttatttgaagtagagggtaaatcagcggtaagaacagtgaacacagtggttgggataaaataaggtgacaaacatcacaccaaagatgagggtagcgagcaactggcttgagcagacagaacggggaagactccactctgtcccgaggggccagccgcaggcgtccccagggccaccctgccctgaggtccttgtgtggccgccctggcttggcagccctgcccacgctgcccccgcaaacaatggtgtgtgcgtttttacagccctttttaggaacccaatatgggcataaatgtaacacctgtagcgggggcagattctctgtatgttcagttaacaaattatttgtaatgtatttttttagaaatcttaaaattgcctttgcactgaagtattttcatagctgtttatatctcttttattcatttatttaacatactgtctaattttaaaaataggtttttaaagctttcatttttaagtttatgaaattttggccactttacatttagattctggtgagagttttgactgaatgttccaatctctgatgaatgcgaattttcagatttgattttattctctacacacacctcttcttttcttggtatttctggtggcagtgattagttgaacagcacatttaaggcacgataatttgctacactttttctttacaatttgttgcaatttcatctgctttctatgtttcattgttaattgccatccttcagccttaaaaatagaagattctcacgtgaaggtttagtaagttgggtcccagctctgcctgtgtggagatagtcaccatgtacctctgacaacaagttttagtgtgaaagtcactaaacttttacacactcccaaacgtctttttaaaaattgcttgggaaattattaaatgaatgtgcctgatgatttgaaatagacaaggggcacgagataaaaaagaaaaggatgagaagatcctcagtgaatgacgttgcagggtcttcatgcaattttccacctcgcagtagttagtatttacttgccttaaactaactttgaagcaagtaatgtcaactttgagcactttgttgagttttgaaaaatcttatttgttgctgcacagatgcatgcacacaaacgtgtacacaagtgtgagctcctacacgcatacacacacacacgtgtacatgcaccaaagcatgtgtgacctacagacatgcagaacatgcacgtgtacacataccacagacacgcgtgtgcatgctcctacacaatacatatgcacatatcatgaacagcgtaagttcctacacacggacgtgtgatacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacatgtacacatgcacatgtacgcaccacaaacacatgcgcaggctcctgcaggcgtgaatacacacatgcacacacatatacacacacgtgccacaaacaagtgcacactgtcctggtgtcctgcactgcatcctgcctccttgctgaggggcccctgtgagaggcctctggatgggcatgggaagatgggctccctggcccccagcccatgcctccctgggatgaagagtccccctcctggcagaatgtctgggctttgcagagcaggccccgggggtgaagtcgcagcttcacttacaccagctgctctgtgagcaaggcttggtgccctggacaaggcccttcccctttagggaggtccagcctcgcaagctgaaacctcccctcggctcagccctataccaggcggccacagcaggactggccacacccacgccgcacctcatccgtgcacgcgtcggagcacggccagccttccgccacgagccagctgggaagggccgcggccgcctaaagccccagtcaacccagcctgtgtctgagcagacagggcgaacaagcaggccacaccgtctcgagggaggaggccagatgcggccagcgtctccaacagggtgaccatccgctcggcttgctgagcgtttaaacaaatgtttagacaggctgtggggactcccctgagttgagccttggccaggggtccggtgctgtcgcgggaaacctccagccttgttcttcaaaccactcagctcatgtgttttgcactgactagtactgaataatacaaccactcttatttaatgttagtattatttatttgacaactcagtgtctaacagcttgatatgcaggtccttgcatcctacatttctttaggaagttacccatttgtaactttaaaaacaggaaaaatatcagttggcaaatgcaatcttttttttttttaagctaaaggtgggtgaactggaatgaaaatctttctgatgttgtgtctataagcagccttgatgggatatgttagaagtgtcatgaaagtgtgattctacttttgcagaaaaatctaaagatcaatttatatagctttattttttactttatcaaagtatacagaattttaatatgcatatattgtgtctgacttaaaattataatgtctgcgtcaccatttaaaatgtctgttcattatgtaatgtaataaaagaaggtcttcaaaaatgtatttaacatgaatggtatccatagttgtcatcatcataaatactggagtttatttttaaattattaaacatagtaggtgcattaacataaatcagtctccacacagtaacatttaactgataattcattaatcagctttgaaaaattaaattgttaattaaaccaatctaacatttcagtaaagtttattttgtatgcttctgtttttaacttttatttctgtagataaactgactggataatattatattggacttttctctagattatctaagcaggagacctgaatctgcttgcaataaagaataaaagtctgcttcagtttctttataaagaaactcacacaagtg

SEQ ID NO: 322965 - DNA, 408 bp, Homo sapiens
atgggaggacacccctcacccagcagccctctgtgtgtcccctgaggaagggccagggctgccccagccattctgctgtggagagctccacagttaccagatggaatcacgtgagcacccgtgtggacggtgtgaccttctgcatttctctttcaggtttgaattgctggaaattttgagttttgactcagtcagaaggagaatgagtgtaattgtaaaatctgctacaggtaaaatttctttttcttttgatttattaagttatacgtggtggttgtgttttattctgatgactaaattctacaggagctttaaggatttagggtttaagaatgatttattctttttttaaaaactatagacaaatcctcacaaaatactaattttttatttttaaaaagtgcaaca

SEQ ID NO: 322966 - DNA, 390 bp, Homo sapiens
gcctctcagggcatccatgggaggacacccctcacccagcagccctctgtgtgtcccctgaggaagggccagggctgccccagccattctgctgtggagagctccacagttaccagatggaatcacgtgagcacccgtgtggacggtgtgaccttctgcatttctctttcaggtttgaattgctggaaattttgagttttgactcagtcagaaggagaatgagtgtaattgtaaaatctgctacaggtaaaatttctttttcttttgatttattaagttatacgtggtggttgtgttttattctgatgactaaattctacaggagctttaaggatttagggtttaagaatgatttattctttttttaaaaactatagacaaatcctcaca

SEQ ID NO: 322967 - DNA, 586 bp, Homo sapiens
attggcgatggtgcaaatgatgtcagcatgattctggaagcgcacgtgggcataggtgagcttcgtccttgctgctggcacatcctggtggccaggtcaccccttcgctagacaaaggcccatggcagcacgcaggtgcattcaggacacccccgtcaccaccctcgtgtgtgaccgggaaggctcatgatgatggtttcatccgttcttctccccgtccctgccctgtgtgtggtgtgcagaaagcatttcttcagctccttcacctccgtcttctaggtgtcatcggcaaggaaggccgccaggctgccaggaacagcgactatgcaatcccaaagtttaagcatttgaagaagatgctgcttgttcacgggcatttttattacattaggatctctgagctcgtgcagtacttcttctataaggtaggagggtcgccgctccccctcacggtgttagcaacaggtcacgcacagggtggcacgacccttgtctgagccacttgatgccacaagaggtcattgatctccgaggagcagcaactgtcagaaaggaaggggtgaatctgattgcagtcatctcttgc

SEQ ID NO: 322968 - DNA, 2263 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgcccccc

SEQ ID NO: 322969 - DNA, 3837 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagactctgtctcaataaataaaaaataataataaattgctcagatttctttgtttcctttttagatctgctactctgtttggataatgtcttattccttatgttttggtcccatctttcatggttttatttttatttatattttaggttttgagacagggtcttgctctgttcaccaggctagagtgcagtggtacaatctcggcttactgcgacctctggttcctgggctcaagcagttctcctgcctcagcctcccgagtagctgggattacgggcgcccgccaccgcgcctggctaatttttgtatttttagtagagacggtgtttcagcatgttggccaggctggtctcgaactcctggccataggtgatctgcctgcctcgtcctcccaaagtactgggattacaggcgtgagccactgcacccacccacgcctggctgatgtttttattttactcatcctgactgaggtctgacaatcctagaagctgaagttcccgggcatccttttgtttcttctgactccccttagtgatagattttcttgtgatttgggattggatgctcatggccagctgggggctctgtgggaatccggggtggcctactttgcaggcagtccttccagatggttcagccttggctttcgctagctacccaggagcgccagccccagcccattttgtgtgtggttctcagcttgcaggtggccaccaaagccaaccccccccactgccccgattgtgggtccctatgtttgaggttcccggtgatgtttcggggggcttctcccttcttacaagctcggtcatgcatatatttgatctggcgttgccaggcattctgtaagggagggcttttccagttcctggaaatggaactggaaaatgtggctggaaacattaatatggctggaaatggaatttgc

SEQ ID NO: 322970 - DNA, 2649 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagaaccacacagggatcctctagatcaccca

SEQ ID NO: 322971 - DNA, 2177 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagtgggttgggcatgcaccctccctccaaaccctgctgggctgggctgcccaaggggcccaaaaaaaaaaaaaaaccctttttttcccccacgagagagggacgcacacaaacaaaaacaggcggcggcggacgcacacacccaagagaagagagaaaagatgcggggaggcgggaggggacgcaggaggcaaaaaaaagacaacaccgcggcgcccccaagatggggagcgagggagagagaggttttttttcgcgggacaaacagcagaggccccccatagggggggcaacaaagacgcgggaggcacacaaaggttta

SEQ ID NO: 322972 - DNA, 2436 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatagagcagagcgacagtagtgagcgagaacaaggcacaccaccccgacacgacacacgaagcgcaggacagacagcagcgaggagtcgggacagctcacagcgagagcgaacattgccacgggaggccctcctcagccctctccatgccgaccaaccacgaccgcccaccaccgagagacgcggcagacgtcggagagggagctcaaaggagtccaacacgtcggacacggcaataccacagagagcagcacagggtggaaccacactccaccacaccctgcaggcggcatgccaagcaacacctccgagccaaggacgaagccgggatgaccgcagatgcccatacaacacaaacgagacgcaaagatggaccacagaggaccccgagcaggcttgactgaggcaaggttaaacaacccaagccccccaaatcaaggccagagaaacaccccaaccacagtgcgaagttacacggtgcacgtacacgattgccagggacccatacctcacagcggaaagcccagaccagcaaggcccgcagtcaaacgtccgcaccgcagaccgcgctcacaagacacactaccaacctcccttaacacaactacctacaacaaccacacacaccagcacagataccccacaacaccacaccaacagcaactatcacacatagaataccacaaaaaaagtcgtagccttctacttccatcgcgcaccacacgtcactcttcacccacaacaaaacagctagctagaatacacacccatcttactcaacgtcctttcctctcatacacaaccttaccagtagctcctaccaacacaaagccatacctacacacaccaccaaa

SEQ ID NO: 322973 - DNA, 3756 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagactctgtctcaataaataaaaaataataataaattgctcagatttctttgtttcctttttagatctgctactctgtttggataatgtcttattccttatgttttggtcccatctttcatggttttatttttatttatattttaggttttgagacagggtcttgctctgttcaccaggctagagtgcagtggtacaatctcggcttactgcgacctctggttcctgggctcaagcagttctcctgcctcagcctcccgagtagctgggattacgggcgcccgccaccgcgcctggctaatttttgtatttttagtagagacggtgtttcagcatgttggccaggctggtctcgaactcctggccataggtgatctgcctgcctcgtcctcccaaagtactgggattacaggcgtgagccactgcacccacccacgcctggctgatgtttttattttactcatcctgactgaggtctgacaatcctagaagctgaagttcccgggcatccttttgtttcttctgactccccttagtgatagattttcttgtgatttgggattggatgctcatggccagctgggggctctgtgggaatccggggtggcctactttgcaggcagtccttccagatggttcagccttggctttcgctagctacccaggagcgccagccccagcccattttgtgtgtggttctcagcttgcaggtggccaccaaagccaaccccccccactgccccgattgtgggtccctatgtttgaggttcccggtgatgtttcggggggcttctcccttcttacaagctcggtcatgcatatatttgatctggcgttgccaggcattctgtaagggagggcttttccagttcctggaaatggaactggaaaatgtggctggaaacattaatatggctggaaatggaatttgc

SEQ ID NO: 322974 - DNA, 3122 bp, Homo sapiens
atattttcttcttccggtgtgagagctacatcatgaaaaatcaaacagtcccaatccaagtctttcattgcttcttgaaagccaacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagactctgtctcaataaataaaaaataataataaattgctcagatttctttgtttcctttttagatctgctactctgtttggataatgtcttattccttatgttttggtcccatctttcatggttttatttttatttatattttaggttttgagacagggtcttgctctgttcaccaggctagagtgcagtggtacaatctcggcttactgcgacctctggttcctgggctcaagcagttctcctgcctcagcctcccgagtagctgggattacgggcgcccgccaccgcgcctggctaatttttgtatttttagtagagacggtgtttcagcatgttggccaggctggtctcgaactcctggccataggtgatctgcctgcctcgtcctcccaaagtactgggattacaggcgtgagccactgcacccacccacgcctggctgatgtttttattttactcatcctgactgaggtctgacaatcctagaagctgaagttcccgggcatccttttgtttcttctgactccccttagtgatagattttcttgtgatttgggattggatgctcatggccagctgggggctctgtgggaatccggggtggcctactttgcaggcagtccttccagatggttcagccttggctttcgctagctacccaggagcgccagccccagcccattttgtgtgtggttctcagcttgcaggtggccaccaaagccaaccccccccactgccccgattgtgggtccctatgtttgaggttcccggtgatgtttcggggggcttctcccttcttacaagctcggtcatgcatatatttgatctggcgttgccaggcattctgtaagggagggcttttccagttcctggaaatggaactggaaaatgtggctggaaacattaatatggctggaaatggaatttgc

SEQ ID NO: 322975 - DNA, 1204 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgagcctgattccacgtagcaaagttgactttgtcgcctgcaatcaagcctggaa

SEQ ID NO: 322976 - DNA, 2424 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagactctgtctcaataaataaaaaataataataaattgctcagatttctttgtttcctttttagatctgctactctgtttggataatgtcttattccttatgttttggtcccatctttcatggttttatttttatttatattttaggttttgagacagggtcttgctctgttcaccaggctagagtgcagtggtacaatctcggcttactgcgacctctggttcctgggctcaagcagttctcctgcctcagcctcccgagtagctgggattacgggcgcccgccaccgcgcctggctaatttttgtatttttagtagagacggtgtttcagcatgttggccaggctggtctcgaactcctggccataggtgatctgcctgcctcgtcctcccaaagtactgggattacaggcgtgagccactgcacccacccacgcctggctgatgtttttattttactcatcctgactgaggtctgacaatcctagaagctgaagttcccgggcatccttttgtttcttctgactccccttagtgatagattttcttgtgatttgggattggatgctcatggccagctgggggctctgtgggaatccggggtggcctactttgcaggcagtccttccagatggttcagccttggctttcgctagctacccaggagcgccagccccagcccattttgtgtgtggttctcagcttgcaggtggccaccaaagccaaccccccccactgccccgattgtgggtccctatgtttgaggttcccggtgatgtttcggggggcttctcccttcttacaagctcggtcatgcatatatttgatctggcgttgccaggcattctgtaagggagggcttttccagttcctggaaatggaactggaaaatgtggctggaaacattaatatggctggaaatggaatttgc

SEQ ID NO: 322977 - DNA, 2944 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagactctgtctcaataaataaaaaataataataaattg

SEQ ID NO: 322978 - DNA, 748 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctagtgagtgtggatttggcggggttcgggggttccgacggcgacctcggcgacccctca

SEQ ID NO: 322979 - DNA, 2757 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcac

SEQ ID NO: 322980 - DNA, 3912 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtaggcgatggctgggcgggccggggagatgggggcggtgcttccctgctcttgctcataccctgcccctcccaggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagactctgtctcaataaataaaaaataataataaattgctcagatttctttgtttcctttttagatctgctactctgtttggataatgtcttattccttatgttttggtcccatctttcatggttttatttttatttatattttaggttttgagacagggtcttgctctgttcaccaggctagagtgcagtggtacaatctcggcttactgcgacctctggttcctgggctcaagcagttctcctgcctcagcctcccgagtagctgggattacgggcgcccgccaccgcgcctggctaatttttgtatttttagtagagacggtgtttcagcatgttggccaggctggtctcgaactcctggccataggtgatctgcctgcctcgtcctcccaaagtactgggattacaggcgtgagccactgcacccacccacgcctggctgatgtttttattttactcatcctgactgaggtctgacaatcctagaagctgaagttcccgggcatccttttgtttcttctgactccccttagtgatagattttcttgtgatttgggattggatgctcatggccagctgggggctctgtgggaatccggggtggcctactttgcaggcagtccttccagatggttcagccttggctttcgctagctacccaggagcgccagccccagcccattttgtgtgtggttctcagcttgcaggtggccaccaaagccaaccccccccactgccccgattgtgggtccctatgtttgaggttcccggtgatgtttcggggggcttctcccttcttacaagctcggtcatgcatatatttgatctggcgttgccaggcattctgtaagggagggcttttccagttcctggaaatggaactggaaaatgtggctggaaacattaatatggctggaaatggaatttgc

SEQ ID NO: 322981 - DNA, 2723 bp, Homo sapiens
  misc_feature (2432)..(2432): n is a, c, g, or t
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccctcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggccgaggaggagtgggagaggaggaacaaggtgctgaaccacttcagcatcatgcagcagcggcggctcaaggatcaggaccaggacgaggatgaggaggagaaggagaaacgtggccgcaggaangcgagcgactgcgcatccacgacctggaggacgacctggagatgtcgtccgatgccagtgatgccagtggtgaggaggggggcagagtccccaaggccaagaagaaggcggcgctggccaagggcggcaggaagaagaagaagaagaagggttcagacacgaggccttcgaggacagcgatgatggggacttcgagggccaagaggtggactacatgtcagacggctccagtagctcccaagaagaggctgaaacagccgctatccgctatccaatgggaatcctcggagc

SEQ ID NO: 322982 - DNA, 3288 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagactctgtctcaataaataaaaaataataataaattgctcagatttctttgtttcctttttagatctgctactctgtttggataatgtcttattccttatgttttggtcccatctttcatggttttatttttatttatattttaggttttgagacagggtcttgctctgttcaccaggctagagtgcagtggtacaatctcggcttactgcgacctctggttcctgggctcaagcagttctcctgcctcagcctcccgagtagctgggattacgggcgcccgccaccgcgcctggctaatttttgtatttttagtagagacggtgtttcagcatgttggccaggctggtctcgaactcctggccataggtgatctgcctgcctcgtcctcccaaagtactgggattacaggcgtgagccactgcacccacccacgcctggctgatgtttttattttactcatcctgactgaggtctgacaatcctagaagctgaagttcccgggcatccttttgtttcttctgactccccttagtgatagattttcttgtgatttgggattggatgctcatggccagctgggggctctgtgggaatccggggtggcctactttgcaggcagtccttccagatggttcagccttggctttcgctagctacccaggagcgccagccccagcccattttgtgtgtggttctcagcttgcaggtggccaccaaagccaaccccccccactgccccgattgtgggtccctatgtttgaggttcccggtgatgtttcggggggcttctcccttcttacaagctcggtcatgcatatatttgatctggcgttgccaggcattctgtaagggagggcttttccagttcctggaaatggaactggaaaatgtggctggaaacattaatatggctggaaatggaatttgc

SEQ ID NO: 322983 - DNA, 1501 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggagggggcagagtccccaaggccaagaagaaggcgcctggtggaatacagtggtgcaaccatggctcactgcgaactcaacctcctaggctcaagcaagttcccaaagagccacccaacggccacgcaacgagggaccgagctc

SEQ ID NO: 322984 - DNA, 1237 bp, Homo sapiens
accccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagagatggggtttcaccgtggtctcgatctcctgacctcgtgatctgcctgcctcggcctcccaa

SEQ ID NO: 322985 - DNA, 191 bp, Homo sapiens
taggactggccaagggtctgtgcttcttaacaggacctagtaatgctgatgctggtggctagggaccacactgagaaccactgcactaatccacttctcaagctggaacaacaagtggtgtgtgtgtgtgtgtgtgtgtgtgtgtgtgtgtatgtattattttattttttgagatggcatctcgctctgtc

SEQ ID NO: 322986 - DNA, 737 bp, Homo sapiens
gaggagtgcggctggatgtccattataggatggggctgtgttccctggccagtgtgtgctggtggggtgggggtacaaagtgggtgttctggagtgaacatctcacctcctcaggctctaaaccctaaggcctgtggctcagggagtggcccgaggggtctacagagtcacactggtagcacccactaggcgggaggtggagtgagtgctgttctttcccggaagagctgggtgtggggagctgagggggcccaggcctcagccctggtgctgtccctgtgacaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggaggtgtgtcctgtgtcgggctggctatggtcctcagggtctcctatagtgggcaggctcagtccactgtgcatcctctcatggctgtgaggcaaatcgagggtctgatgtgtgtgatctgagtcgcttgcacacctaccacgaccgtctatggttgggctctggaaaaggcagcaatgggtttctcggaaccggggttgaggccg

SEQ ID NO: 322987 - DNA, 504 bp, Homo sapiens
  misc_feature (44)..(44): n is a, c, g, or t
cgtacccacggaaggttagactcacatcttacaagatggccaangaggcattttccaggacacgatgaggaagttcctggagcaggagtgcaacgtcctccccttgaagctgctcatgccccagtgcaaccaagtgcttgacgactacttccccctggtcatcgactacttccagaaccagactgtgagggctgcaagctcacctcctgcctgcctccccacgcaggcccctgtgcccacccatggggagccacacacacagcaccccagccagccagacacacacacacacacacacacacacagcacccaagccggccagacacaaacacacagcaccccagccagccggaacacacacacacacacacacaacaccccagctggccggacacacacacacacagtaccccagctggccggacacacacacacacagcaccctatccagacacatacacacacacagtaccccagccagctggaaacacacacacacacagc

SEQ ID NO: 322988 - DNA, 530 bp, Homo sapiens
ctccaagttggactcaggcaaggatggggaatctatctgtggaaattcccctcttgaaagatcaaagcaacctttctacagagacctctggggatctttctccatcagatggtgacctgcagtggctattgtccaatggccccgccagcccagggctaccttgcccaaattggggcccaaatgaggaaaggccctgccccctcagcctttcccagatagggttgcgtgggccaccaggggcacaaggcagcaggtgaggttcctgctgaggcaggtggttcacttgagcccaggagttcaagaccagctggccaacatggcgaaaccctgtctctactaaaaatattttttaaaaattagctgagcatggtggcaggtgcctgtaatcccagctactcaggacgcttaggcaggagaatcacttgaacctgggaggcgaaggttgcggtgtgccgagatcgtgccactgcactctagcctaggcaacagagcacaactctgtctcaggaaaaaaaaaaaaaaaaaaaagg

SEQ ID NO: 322989 - DNA, 673 bp, Homo sapiens
aaattgatatggatgagatgggacaagttgggctggtgggcagctgcatgtgccttggagtgctctgttggcctcttcctaagagaacctccccattggagctgggagcctcccccactcatgtgtcctccaccttggggcccctccatccccaggatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgtgagggctgcaagctcacctcctgcctgcctccccacgcaggcccctgtgcccacccatggggagccacacacacagcaccccagccagccagacacacacacacacacacacacacacagcacccaagccggccagacacaaacacacagcaccccagccagccggaacacacacacacacacacacaacaccccagctggccggacacacacacacacagtaccccagctggccggacacacacacacacagcaccctatccagacacatacacacacacagtaccccagccagctggaaacacacacacacacagc

SEQ ID NO: 322990 - DNA, 3660 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 322991 - DNA, 3704 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 322992 - DNA, 4080 bp, Homo sapiens
  misc_feature (330)..(330): n is a, c, g, or t
tggtgccaaaaaattcgacatggaaacctttgtggaatgcttaacgcgttcccaggaccggaacttaaatagccggttaaacaattagtcaccaaatacagtcctcgagttttttgccaagaacacatgagtatttgtctaaaacagggtctcctttgaagcactaggccctgccaccacggtgcttgcctgagttcacaaatctgttgaacctgtagcttccctgtcactttctctggctctcctctgcctgctaagctttgtttcctaatgtaaatgcttctgccactgccatagctactgctgctgctgggaaccgccatagccacnttggtttcgtgtttttgcaaagtattggcctccaccgccataggggccagagcttctgcctccaaaatttcctcccttcatgggtccaaaatttgaagactgattgttgtaattcccaaaatcattgtagcttccaccacctccaaaattgcttccatcattaccaaatccattatagccatccccactgccaccatatccaccaccaccacggctgccaccaaagccaccacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 322993 - DNA, 2451 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaaaaaaaaaaaaaacctcttttgggcggcttgggcccctgaaaaaagtttttaagaaccaattccgtttgggccgcgcgggccccatgttgcgttagcgtcaaccgtgtggcgctatcacgcgtgggccccaaaggagagaacccggggccaaacacatgagcgcgtggggcttcctcccccgatgaagaaaaaacccgcccgggcggggacacccgcgagcgcgttctgtggcacaaaccccgagatgggggcccccagagggacaataacggcgcgctctcactcacagggggagtcccacagacagagcccgagaaataaatgca

SEQ ID NO: 322994 - DNA, 3572 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 322995 - DNA, 3744 bp, Homo sapiens
caggaggcggaggttgcagtgagccgacatcacgccactgtactctagcctgggtgacagagcaagactctgtctcaaaaaaaaagaaagaaggaaagatcactgcagagattgcagtgagaggtgatgggacagggacggagctgagggctggcctggggatgcatttgggaggtgggcccactgctattgggcatggatgggcctggagcgtgaggaccagggaggactccaaagtgacttttacacactggccagagcaaccagccctctgtaatgccagcagctgagatggggagactaaagaagaaaacaggtttgagcaaaaaaacagagagctccctcctggccatgttgagttcaagatgcctgtgtgaagtgcaggagaggagagtcaggcaagcagctgaatcccaagcattgggggaaggtcaggtccaccatgtcagtctgagagtcactagctgtgggccagagcctttggggccagacgtaggtctgaagctggctcctacactcagtgaccctgtgtgagtcccctgcatcccctggactctctgatccccagtgtccttatttgtgaatagccttgccctcccttctagaagagaatgagggaatgcgtaggaagtgcccagctgggtgctgggcagagagtggaggcttgccaagtgaaggtcccatgctggcctctctccgcccccgccccagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 322996 - DNA, 2735 bp, Homo sapiens
gaggagtgcggctggatgtccattataggatggggctgtgttccctggccagtgtgtgctggtggggtgggggtacaaagtgggtgttctggagtgaacatctcacctcctcaggctctaaaccctaaggcctgtggctcagggagtggcccgaggggtctacagagtcacactggtagcacccactaggcgggaggtggagtgagtgctgttctttcccggaagagctgggtgtggggagctgagggggcccaggcctcagccctggtgctgtccctgtgacaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 322997 - DNA, 2415 bp, Homo sapiens
gtctctagagttccctgcagctctctgatgacaactctgctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 322998 - DNA, 2832 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 322999 - DNA, 2303 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggtgagtccaggcccccagttgcggggaggtaagggggcaggtcctgaccatcagggcatgggaggcccttctgctccccaagcaggaagaggcggccactcctgccggctgctccatcctccctctcaccgcacagctggaggctcctgagggcttctggctggccatcaggaaaacaccctttccggaccccgagcactgccccgcccagaaccccagtcactgagtgcccaacccccagcttcccccccaaccccccgccctgccctgtcccaggcctccctctcagagcttgccccagggactctctggccctcagggttcaatgtattctgaccaaggccaagctttcctggggctcagggaaaatcacactttgctacccgaagctgtatcccctcagatgccaggaaggccgtgatcatctgactccaccctcctgagacacattctctccctgactgtcctgttctaagtcagcggagcaccttaggatggaggggtggaggcgaggccagatgcagcctctgtgaacaggtgcctggaggctgggaaatgaccctgagagggcaggacacagcaaccgtgggcttaaggtgaccttgagagcaagcttggcccactttacaattctgttcagagccagcccctaacatggtggtcatttattcatttgttccctcattttaaaaaatgtaaggccaggcatggtggctcacgccggtaatcccagcactttgggaggccgaggcaggcagatcacctgaggtcaggagttcgagactagcctggccaacatggcgaaaccctgtctctactaaaaatattttttaaaaattagctgagcatggtggcaggtgcctgtaatcccagctactcaggacgcttaggcaggagaatcacttgaacctgggaggcgaaggttgcggtgtgccgagatcgtgccactgcactctagcctaggcaacagagcacaactctgtctcaggaaaaaaaaaaaaaaaaaaaagg

SEQ ID NO: 323000 - DNA, 1378 bp, Homo sapiens
gaggagtgcggctggatgtccattataggatggggctgtgttccctggccagtgtgtgctggtggggtgggggtacaaagtgggtgttctggagtgaacatctcacctcctcaggctctaaaccctaaggcctgtggctcagggagtggcccgaggggtctacagagtcacactggtagcacccactaggcgggaggtggagtgagtgctgttctttcccggaagagctgggtgtggggagctgagggggcccaggcctcagccctggtgctgtccctgtgacaggccctcggggtgtgtgggaccatgtccagccctctccagtgtatccacagccccgacctttgatgagaactcagctgtccaggtgagtccaggcccccagttgcggggaggtaagggggcaggtcctgaccatcagggcatgggaggcccttctgctccccaagcaggaagaggcggccactcctgccggctgctccatcctccctctcaccgcacagctggaggctcctgagggcttctggctggccatcaggaaaacaccctttccggaccccgagcactgccccgcccagaaccccagtcactgagtgcccaacccccagcttcccccccaaccccccgccctgccctgtcccaggcctccctctcagagcttgccccagggactctctggccctcagggttcaatgtattctgaccaaggccaagctttcctggggctcagggaaaatcacactttgctacccgaagctgtatcccctcagatgccaggaaggccgtgatcatctgactccaccctcctgagacacattctctccctgactgtcctgttctaagtcagcggagcaccttaggatggaggggtggaggcgaggccagatgcagcctctgtgaacaggtgcctggaggctgggaaatgaccctgagagggcaggacacagcaaccgtgggcttaaggtgaccttgagagcaagcttggcccactttacaattctgttcagagccagcccctaacatggtggtcatttattcatttgttccctcattttaaaaaatgtaaggccaggcatggtggctcacgccggtaatcccagcactttgggaggccgaggcaggcagatcacctgaggtcaggagttcgagactagcctggccaacatggcgaaaccctgtctctactaaaaatattttttaaaaattagctgagcatggtggcaggtgcctgtaatcccagctactcaggacgcttaggcaggagaatcacttgaacctgggaggcgaaggttgcggtgtgccgagatcgtgccactgcactctagcctaggcaacagagcacaactctgtctcaggaaaaaaaaaaaaaaaaaaaagg

SEQ ID NO: 323001 - DNA, 348 bp, Homo sapiens
tctgtagaaaggttgctttgatctttcaagaggggaatttccacagatagattccccatccttgcctgagtccaacttggagtcttccagacctgcagtggctattgtccaatggccccgccagcccagggctaccttgcccaaattggggcccaaatgaggaaaggccctgccccctcagcctttcccagatagggttgcgtgggccaccaggggcacaaggcagcaggtgaggttcctgctgaggcaggtggttcacttgagcccaggagttcaagaccagcttgggcaacatggcgaaaccccgtctctactaagaatacaaaaattagccagatgtgacaggtg

SEQ ID NO: 323002 - DNA, 591 bp, Homo sapiens
aaattgatatggatgagatgggacaagttgggctggtgggcagctgcatgtgccttggagtgctctgttggcctcttcctaagagaacctccccattggagctgggagcctcccccactcatgtgtcctccaccttggggcccctccatccccaggatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctggatctccactttactggctgtgggggcctccctcacctgtgtgtgaggcccaggcctcgcctggagggccccgggcagcacagggaggacgagcttgtccagggtaccgagctcg

SEQ ID NO: 323003 - DNA, 2120 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaaga

SEQ ID NO: 323004 - DNA, 2932 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagagttccagaccagcctaacatggtgaaaccacatatctactaaaaaaaatacaaaattagctggatgtggtagtgcatgcctgttatcccagctacttggaaggctgagacaggagaattgcttgaacccaggaggcagaggctgcagtgagccaggattgcgccactgcactccagcctgggcaacaagagcaaaactct

SEQ ID NO: 323005 - DNA, 2673 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctccccaccactgcctcggctctactctgccttcctcatggctactcctcgtctgatggag

SEQ ID NO: 323006 - DNA, 3629 bp, Homo sapiens
gacacatacccacacagtaccccagccagccagacacacacacacacacacacacacacacacacacagcacacacacagcaccccagctggccacacacacacacacacacaccctgtccacaaagggcctaggaaactacgtgcccttcagccatgcacccgaccatgggcccccaggttcaggtgcacacggtgggcctgtacgctcacacacccttacaccctcactctcacacacatgcttacacacttattcattctcacatatatgctcatgctcattcacacacaatcccggccacctgccctaaagtccccacacagccctatctttgccttttgtccccccacatagagttctaaaccacagcacccccactaggcctgcttcctcccattccagtggtccctgagcccttgggccggcctgaataggggtgggcttccctcccagaccctaacactcccaccctgtgctgtgccccaggactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 323007 - DNA, 3832 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 323008 - DNA, 2744 bp, Homo sapiens
ggagctcacagccaagtccacttcttccatctgaggcggggaagccagccctgttcctgaaaccctgcatcacaagcccctgtgggaggcagtggggaggggaggtcctcccccactcagacctgacccacagggaccagtttaatgtgtccttgccccagtgatgacagctggggatctgggggtggggagtcacccaggacccgggcagtcgcctttccccagctcctagggctcccggccttccctgctgaaacagcaagaccagtgggttggcgtgggaggcctgggcttcaaaccacctctgctatcacctggctgtgggtccccaggcaggacatacacacagtccctctctggccctcatcctcctcagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 323009 - DNA, 2416 bp, Homo sapiens
ttccctcgggcttttgcttcccttactccaagccatgcagtttggatggaaggccttcattctgatggtgcctgcatggtgattgcatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagac

SEQ ID NO: 323010 - DNA, 2338 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaaaaaaacaaaaacaaaaaacaacacaaaaaaaaaaaacaaaaaaacaaacaacaagaacaaaaaaacccaacacacacaaaaaacgaggggggggccgccacaagaaatttcccaggaaggggggccaacaaaaagagcgccaacacacaaactagtatgtaactaaacagaggggggccaccaaagaagacgcgacacaacataaaagagacagacacacacgcgccgacggaaaaacacaacacaagcgaagaagaggaaaaaaacacaccacggggacccaaatcttaagaagacgagagaaaccaccccatatcacctgcgggagggcggacggcgacacaaacaactgggtgcgggcggcaccacaaacactccaacccagagaggacaaagtgacaaatagcgatctagacgaggaggtaatataacaagacaatatgtattagtgaagtgtggcatgatgttgggtggcagaaaaagacgccggtgcaataatagataggaagtggggaaggaaaaaaattgtctgtccacggcgatggtgaaggtgaatcggaagaaaaattttttgagc

SEQ ID NO: 323011 - DNA, 1367 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagtgagcccactgccccctccttagcccaatgcctgctctcctcctccccctaccctgccactgcatgaccctctccctctgtggtcccactgcaatgcaccaaggaggacagaaaccaaacacctctgtagggtggccttgcctgctttccccctaatgctcacatctccagggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagctggctccagtttgttaagggtttcaactgcagccagaggtgttccgtgagggctgatggaggagt

SEQ ID NO: 323012 - DNA, 585 bp, Homo sapiens
tcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcggctcccacatgtccccagacttcctgtaggcaatgccctagggctctgcactgcaatgcttgctccaggctttggcaccagaact

SEQ ID NO: 323013 - DNA, 894 bp, Homo sapiens
ccatgaaataatggagttctaggaaataatgcatcttaggaaaggttgttcttccctctagctatgaattgccctatgggattttagatagcatttcccacttgatgctccttgccctcatcaccattcatcttattactacagtcagtttctgtggactaccaagataatagcgctttcccaaacacaagcactcattttaaagcagttatcttttaatgtgaattctctttgttaaaatgtcaatgttgtgagatttggtagcatattcctatttaaactagtgaatatgattttgatatgaaccttgaaagatggggaatttgagtgcttttaacgtgttgaaagtgtaacacttgaaactttggaggctgggaaatcgaggcgatgaagtgttctataagataggttttctgcccttttaaatatagtggtgctgtctttgtttccaattggaatttcagtgtaatgcactgttctcacttcagatgcagaggaaggataaaatagtgaagttgatatggccctgttcagccaaatttccgaatcataaagtgacatgctaataggatatactgtggcatttctgtgtattacagcttgtatggtttgagttacttttccacacataattttttctcctccacacaagtcattaaatatgttttcctgagagatagtcaagctttgttgtataggaaagtttcgtttgtggaaataaatgagtttcactgtaagctaatgtaattctattacgtgaggaaatgttccttaaaaaataaagaatattatatactgttgttttcctgaatattttttaaaagacacattaactatttcctatttcatccttcatggacatcccacaatagattaccagcaccttaaaaaaaa

SEQ ID NO: 323014 - DNA, 581 bp, Homo sapiens
ggaatattttccatctgctgttggttgaatccacagatgcagaacccaaggatatggagggccaaagaagcatttacagaggaaggacagtgtagattcatgaaaactaaggaaggagatttgaaacaggaagacttgattcacagttttaaaggctgcaaaggaggtaaattgaaaaaaagactaagaggccatgtgaaggtcatcaagcatcatccagagagaaattccgcagagcaatcagtgcaaaatccatgttttcattaccaaaaaccaaaaactttatcacaatatgatatgaacttacctatatgaagtctttcagtggccccaaaacaaatcatatatatttaatgaatagccattattgaaaaaatatatactaaaaagtaactacactggaaaacccatgatgtattgttactattgtaattgggagagaagtcagatgttagaatattttaggaatgaaataggtcaaaagaaagaaaaatgtgaaggatatgaataaacagagaaatgtaggagggacaaaaggacaccctctttaaactgtcaatggcaggctagaactgtttgtg

SEQ ID NO: 323015 - DNA, 478 bp, Homo sapiens
aggcttctgccactgcactcacaaccatgctgtgttgtgacgatttctcagagtagataatttctcagatgggactgggagctccaagagagggtagcagagaatgggggaagatcctccacaaatatgcctctccattcttccagctgccaccccacgcctcccaacacacaatcatatatcaggagataaagacaccatccattgtggcagtatggcatcctcgtaaaaaacatgggctctggagtcccacagtcccagacctgaatagcagcactgccactgatggctagctgtgtgaccttggacaagttgtacattctctgtaagccccagctttatcttctgttaaaggagactgagtgtgtctcccatccatggttgtgggatgattcagtggggtcgtgcacttaaaagcgcttgccttagcacagtgccacacatagagtgctcaataaatactatcctagtaggcttt

SEQ ID NO: 323016 - DNA, 4687 bp, Homo sapiens
  misc_feature (517)..(517): n is a, c, g, or t
  misc_feature (562)..(562): n is a, c, g, or t
  misc_feature (636)..(636): n is a, c, g, or t
cgcccgctgctccgcgcgcagccggctcgggccgctcctcctgactgaggcgcggcggcggcggtggctgtgaccgcgcggaccgagccgagacattcgcgccgggggatcgggcgccgccgccgctgggccccgggcgcgtggatgcggctgggtcgggcggcgccgtacacctgaggcggagaacggggcgcggcgcgggtgacgctgtcagggccgcggttcctgacgcccaggcgctcgccaggacgagccaggcagtgatttgaggcaccggcttcaccttcacccatggtccggagagcctagcggggctcgccaccgcctcccggctccccttccacgcctcatcctgccagcctcgccgccccgccagcgccgggcaaccgcctcgcccgaagccctccctcgttactgtccgcataccccggcggcgccgccgcgggaagcggctccccctcctcttcctccgcgtcctcttccctctttcccccgccggggccgcttgttgcaccgncccgcggcctgcgggagccgctcgccccggccttgtgctcgcgtncgcacccctttcctgtcgccccccggggcccgcaccacagcccggccggcgagaccccggccagaccccgctgnccgcacaaaatgtcggcccggacgccattgccgacggtgaacgagcgggacacggaaaatcatacatctgtggatggatatactgaaccacacatccagcctaccaagtcgagtagcagacagaacatcccccggtgtagaaactccattacgtcagcaacagatgaacagcctcacattggaaattaccgtttacaaaaaacaatagggaagggaaattttgccaaagtcaaattggcaagacacgttctaactggtagagaggttgctgtgaaaataatagacaaaactcagctaaatcctaccagtctacaaaagttatttcgagaagtacgaataatgaagatactgaatcatcctaatataggtgaagtatttgattacttagttgcccatggaagaatgaaagagaaagaggcccgtgcaaaatttaggcagattgtatctgctgtacagtattgtcatcaaaagtacattgttcaccgtgatcttaaggctgaaaaccttctccttgatggtgatatgaatattaaaattgctgactttggttttagtaatgaatttacagttgggaacaaattggacacattttgtggaagcccaccctatgctgctcccgagcttttccaaggaaagaagtatgatgggcctgaagtggatgtgtggagtctgggcgtcattctctatacattagtcagtggctccttgcctttcgatggccagaatttaaaggaactgcgagagcgagttttacgagggaagtaccgtattcccttctatatgtccacagactgtgaaaatcttctgaagaaattattagtcctgaatccaataaagagaggcagcttggaacaaataatgaaagatcgatggatgaatgttggtcatgaagaggaagaactaaagccatatactgagcctgatccggatttcaatgacacaaaaagaatagacattatggtcaccatgggctttgcacgagatgaaataaatgatgccttaataaatcagaagtatgatgaagttatggctacttatattcttctaggtagaaaaccacctgaatttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatgctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtaacaatgtgtattctggaggtagcatggcaagaaggaatacatatgtctgtgaaaggaccacagatcgatacgtagcattgcagaatggaaaagacagcagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctggtacaacccagagagtgcctgctgcttccccatctgctcacagtattagtactgcgactccagaccggacccgttttccccgagggagctcaagccgaagcactttccatggtgaacagctccgggagcgacgcagcgttgcttataatgggccacctgcttcaccatcccatgaaacgggtgcatttgcacatgccagaaggggaacgtcaactggtataataagcaaaatcacatccaaatttgttcgcagaagtacatcaggggaaccaaaagaaagagacaaggaagagggtaaagattctaagccgcgttctttgcggttcacatggagtatgaagaccactagttcaatggaccctaatgacatgatgagagaaatccgaaaagtgttagatgcaaataactgtgattatgagcaaaaagagagatttttgcttttctgtgtccatggagacgctagacaggatagcctcgtgcagtgggagatggaagtctgcaagttgccacgactgtcacttaatggggttcgcttcaagcgaatatctgggacatctattgcctttaagaacattgcatcaaaaatagcaaatgagcttaagctgtaaagaagtccaaatttacaggttcagggaagatacatacatatatgaggtacagtttttgaatgtactggtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaaaaacttgtatagttgtctagatttctgcacctgaatgtatgtttgatgctttgatttgaaaatgttcttccctgttatttacattctggtgggtttttaaaattcttacctccatcatgcaattttgaaaattgtgtccagaattaaaagtgcatagaaatagcctttacaattgtagcatggacctttaaaaattgttttaaaatcttatttaaatttaaaccagaagctgaaaaatagatcagctttattatacacaaaattattactgcttatctttgctcttttccttgttatcccgcaaggtttagttgagaagatacaaaatgtttacagtgttggcacttagagtttttaaattcaagtacatgaaattcagtaatagcattgccttgagctaactaggaagtaccgggaaaaaagttaaatctacatcaagtttcttttgaactttgaagtgttttctgacccactgctaactgtagcaacaaaatttaaaagaaaaaaaacatactttatctggctattataacataaactgtcacgtaggtttgctgccttcagaataccgcaatttaattgcgggaatataataatattgggactgtttcacagcacaaactcatctttacagtgttgatcaatgcatcagttaagaaataatgccacctcaggaattaactggcattgggaacatttgcctcattctcctgctatcctcttcattcacccctgccactgtaatatctataagtacttaagagacttgtgagcaaaacatactatttataacagtatatgattgatttatgcttatgtggttgttcagtttgttcccatgtaactcgtttgttttaaatattttgccagatttcttgtatttattccacatcattatgcctataatgtgccgctttgtgattgggcatttgcctacttttctttcataattagtgatatatgcgatgtaaaaccactagtaaaggtacattttaatacttgttattttatactgaattagccttggaggttgactgtgcaatgttatttactgttgtaattactgtaataccaacatatgggccccatctgcacactcctgaaaaacagaaagtgtattcaaattttatcagtttaaagaaaataaagctgtgataaatactgtaattccaacctacattagaaggtctaagtgtaggtgatgtgccattccataatggcttccagactagggtgaattttatgttctgtactgtactgtgatgtagctttcttctgtaacagttatgttttaaaattaagtgagttttttttttgccttagcaaagggtggtgtttgaaaaaaaaaatgtgtagcccctttttaacctagtgttcattcaaaaaaaaattgatgcaaatctttattcactttcactggtgcacactgaaattttacttgaacagttctcataataaagcacttgtcttttgctcttta

SEQ ID NO: 323017 - DNA, 3318 bp, Homo sapiens
  misc_feature (517)..(517): n is a, c, g, or t
  misc_feature (562)..(562): n is a, c, g, or t
  misc_feature (636)..(636): n is a, c, g, or t
cgcccgctgctccgcgcgcagccggctcgggccgctcctcctgactgaggcgcggcggcggcggtggctgtgaccgcgcggaccgagccgagacattcgcgccgggggatcgggcgccgccgccgctgggccccgggcgcgtggatgcggctgggtcgggcggcgccgtacacctgaggcggagaacggggcgcggcgcgggtgacgctgtcagggccgcggttcctgacgcccaggcgctcgccaggacgagccaggcagtgatttgaggcaccggcttcaccttcacccatggtccggagagcctagcggggctcgccaccgcctcccggctccccttccacgcctcatcctgccagcctcgccgccccgccagcgccgggcaaccgcctcgcccgaagccctccctcgttactgtccgcataccccggcggcgccgccgcgggaagcggctccccctcctcttcctccgcgtcctcttccctctttcccccgccggggccgcttgttgcaccgncccgcggcctgcgggagccgctcgccccggccttgtgctcgcgtncgcacccctttcctgtcgccccccggggcccgcaccacagcccggccggcgagaccccggccagaccccgctgnccgcacaaaatgtcggcccggacgccattgccgacggtgaacgagcgggacacggaaaatcatacatctgtggatggatatactgaaccacacatccagcctaccaagtcgagtagcagacagaacatcccccggtgtagaaactccattacgtcagcaacagatgaacagcctcacattggaaattaccgtttacaaaaaacaatagggaagggaaattttgccaaagtcaaattggcaagacacgttctaactggtagagaggttgctgtgaaaataatagacaaaactcagctaaatcctaccagtctacaaaagttatttcgagaagtacgaataatgaagatactgaatcatcctaatatagtaaaattgtttgaagttattgaaacagagaagactctctatttagtcatggaatacgcgagtgggggtgaagtatttgattacttagttgcccatggaagaatgaaagagaaagaggcccgtgcaaaatttaggcagattgtatctgctgtacagtattgtcatcaaaagtacattgttcaccgtgatcttaaggctgaaaaccttctccttgatggtgatatgaatattaaaattgctgactttggttttagtaatgaatttacagttgggaacaaattggacacattttgtggaagcccaccctatgctgctcccgagcttttccaaggaaagaagtatgatgggcctgaagtggatgtgtggagtctgggcgtcattctctatacattagtcagtggctccttgcctttcgatggccagaatttaaaggaactgcgagagcgagttttacgagggaagtaccgtattcccttctatatgtccacagactgtgaaaatcttctgaagaaattattagtcctgaatccaataaagagaggcagcttggaacaaataatgaaagatcgatggatgaatgttggtcatgaagaggaagaactaaagccatatactgagcctgatccggatttcaatgacacaaaaagaatagacattatggtcaccatgggctttgcacgagatgaaataaatgatgccttaataaatcagaagtatgatgaagttatggctacttatattcttctaggtagaaaaccacctgaatttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatgctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtaacaatgtgtattctggaggtagcatggcaagaaggaatacatatgtctgtgaaaggaccacagatcgatacgtagcattgcagaatggaaaagacagcagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctggtacaacccagagagtgcctgctgcttccccatctgctcacagtattagtactgcgactccagaccggacccgttttccccgagggagctcaagccgaagcactttccatggtgaacagctccgggagcgacgcagcgttgcttataatgggccacctgcttcaccatcccatgaaacgggtgcatttgcacatgccagaaggggaacgtcaactggtataataagcaaaatcacatccaaatttgttcgcagggatccaagtgaaggcgaagccagtggcagaaccgacacctcaagaagtacatcaggggaaccaaaagaaagagacaaggaagagggtaaagattctaagccgcgttctttgcggttcacatggagtatgaagaccactagttcaatggaccctaatgacatgatgagagaaatccgaaaagtgttagatgcaaataactgtgattatgagcaaaaagagagatttttgcttttctgtgtccatggagacgctagacaggatagcctcgtgcagtgggagatggaagtctgcaagttgccacgactgtcacttaatggggttcgcttcaagcgaatatctgggacatctattgcctttaagaacattgcatcaaaaatagcaaatgagcttaagctgtaaagaagtccaaatttacaggttcagggaagatacatacatatatgaggtacagtttttgaatgtactggtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaa

SEQ ID NO: 323018 - DNA, 488 bp, Homo sapiens
  misc_feature (26)..(26): n is a, c, g, or t
  misc_feature (53)..(53): n is a, c, g, or t
  misc_feature (65)..(65): n is a, c, g, or t
  misc_feature (70)..(70): n is a, c, g, or t
aaatccttgaacgcctgctgtggggnctcggccgggtgctgctgaatggtgcnactggtgtaaancccancccacagttcctgtcctcatggaatttgcagccctagtgaggaaagatcctccccaagtcaaataaccacaaggtaactgcagggagagacaccgggataatttctgtgaagagaggacatggggtgctccgagagcccctgacagagggaactttgtggtcctagaaaccaggtggtgttttcctgaggaaatgacattttcctctggatcagagctgaggaaggtgcctctgtgtgtcccgtggccgctgtgacactgaccacacacctggggctggaaaataatactcactttagatttttcattttatgtgttcatgacaacataaatatttttcaaagatttagaggaattttgcaatgtgtttgcataaataaataccagtttatgttcaccggctatgtgataccaggatt

SEQ ID NO: 323019 - DNA, 4844 bp, Homo sapiens
  misc_feature (517)..(517): n is a, c, g, or t
  misc_feature (562)..(562): n is a, c, g, or t
  misc_feature (636)..(636): n is a, c, g, or t
cgcccgctgctccgcgcgcagccggctcgggccgctcctcctgactgaggcgcggcggcggcggtggctgtgaccgcgcggaccgagccgagacattcgcgccgggggatcgggcgccgccgccgctgggccccgggcgcgtggatgcggctgggtcgggcggcgccgtacacctgaggcggagaacggggcgcggcgcgggtgacgctgtcagggccgcggttcctgacgcccaggcgctcgccaggacgagccaggcagtgatttgaggcaccggcttcaccttcacccatggtccggagagcctagcggggctcgccaccgcctcccggctccccttccacgcctcatcctgccagcctcgccgccccgccagcgccgggcaaccgcctcgcccgaagccctccctcgttactgtccgcataccccggcggcgccgccgcgggaagcggctccccctcctcttcctccgcgtcctcttccctctttcccccgccggggccgcttgttgcaccgncccgcggcctgcgggagccgctcgccccggccttgtgctcgcgtncgcacccctttcctgtcgccccccggggcccgcaccacagcccggccggcgagaccccggccagaccccgctgnccgcacaaaatgtcggcccggacgccattgccgacggtgaacgagcgggacacggaaaatcaaagatctggacagcatggacttactcctcagaagtcattctataagggtaccaggagtatgaggatcctaaatcccttcaatttagttacatacatctgtggatggatatactgaaccacacatccagcctaccaagtcgagtagcagacagaacatcccccggtgtagaaactccattacgtcagcaacagatgaacagcctcacattggaaattaccgtttacaaaaaacaatagggaagggaaattttgccaaagtcaaattggcaagacacgttctaactggtagagaggttgctgtgaaaataatagacaaaactcagctaaatcctaccagtctacaaaagttatttcgagaagtacgaataatgaagatactgaatcatcctaatatagtaaaattgtttgaagttattgaaacagagaagactctctatttagtcatggaatacgcgagtgggggtgaagtatttgattacttagttgcccatggaagaatgaaagagaaagaggcccgtgcaaaatttaggcagattgtatctgctgtacagtattgtcatcaaaagtacattgttcaccgtgatcttaaggctgaaaaccttctccttgatggtgatatgaatattaaaattgctgactttggttttagtaatgaatttacagttgggaacaaattggacacattttgtggaagcccaccctatgctgctcccgagcttttccaaggaaagaagtatgatgggcctgaagtggatgtgtggagtctgggcgtcattctctatacattagtcagtggctccttgcctttcgatggccagaatttaaaggaactgcgagagcgagttttacgagggaagtaccgtattcccttctatatgtccacagactgtgaaaatcttctgaagaaattattagtcctgaatccaataaagagaggcagcttggaacaaataatgaaagatcgatggatgaatgttggtcatgaagaggaagaactaaagccatatactgagcctgatccggatttcaatgacacaaaaagaatagacattatggtcaccatgggctttgcacgagatgaaataaatgatgccttaataaatcagaagtatgatgaagttatggctacttatattcttctaggtagaaaaccacctgaatttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatgctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtaacaatgtgtattctggaggtagcatggcaagaaggaatacatatgtctgtgaaaggaccacagatcgatacgtagcattgcagaatggaaaagacagcagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctggtacaacccagagagtgcctgctgcttccccatctgctcacagtattagtactgcgactccagaccggacccgttttccccgagggagctcaagccgaagcactttccatggtgaacagctccgggagcgacgcagcgttgcttataatgggccacctgcttcaccatcccatgaaacgggtgcatttgcacatgccagaaggggaacgtcaactggtataataagcaaaatcacatccaaatttgttcgcagaagtacatcaggggaaccaaaagaaagagacaaggaagagggtaaagattctaagccgcgttctttgcggttcacatggagtatgaagaccactagttcaatggaccctaatgacatgatgagagaaatccgaaaagtgttagatgcaaataactgtgattatgagcaaaaagagagatttttgcttttctgtgtccatggagacgctagacaggatagcctcgtgcagtgggagatggaagtctgcaagttgccacgactgtcacttaatggggttcgcttcaagcgaatatctgggacatctattgcctttaagaacattgcatcaaaaatagcaaatgagcttaagctgtaaagaagtccaaatttacaggttcagggaagatacatacatatatgaggtacagtttttgaatgtactggtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaaaaacttgtatagttgtctagatttctgcacctgaatgtatgtttgatgctttgatttgaaaatgttcttccctgttatttacattctggtgggtttttaaaattcttacctccatcatgcaattttgaaaattgtgtccagaattaaaagtgcatagaaatagcctttacaattgtagcatggacctttaaaaattgttttaaaatcttatttaaatttaaaccagaagctgaaaaatagatcagctttattatacacaaaattattactgcttatctttgctcttttccttgttatcccgcaaggtttagttgagaagatacaaaatgtttacagtgttggcacttagagtttttaaattcaagtacatgaaattcagtaatagcattgccttgagctaactaggaagtaccgggaaaaaagttaaatctacatcaagtttcttttgaactttgaagtgttttctgacccactgctaactgtagcaacaaaatttaaaagaaaaaaaacatactttatctggctattataacataaactgtcacgtaggtttgctgccttcagaataccgcaatttaattgcgggaatataataatattgggactgtttcacagcacaaactcatctttacagtgttgatcaatgcatcagttaagaaataatgccacctcaggaattaactggcattgggaacatttgcctcattctcctgctatcctcttcattcacccctgccactgtaatatctataagtacttaagagacttgtgagcaaaacatactatttataacagtatatgattgatttatgcttatgtggttgttcagtttgttcccatgtaactcgtttgttttaaatattttgccagatttcttgtatttattccacatcattatgcctataatgtgccgctttgtgattgggcatttgcctacttttctttcataattagtgatatatgcgatgtaaaaccactagtaaaggtacattttaatacttgttattttatactgaattagccttggaggttgactgtgcaatgttatttactgttgtaattactgtaataccaacatatgggccccatctgcacactcctgaaaaacagaaagtgtattcaaattttatcagtttaaagaaaataaagctgtgataaatactgtaattccaacctacattagaaggtctaagtgtaggtgatgtgccattccataatggcttccagactagggtgaattttatgttctgtactgtactgtgatgtagctttcttctgtaacagttatgttttaaaattaagtgagttttttttttgccttagcaaagggtggtgtttgaaaaaaaaaatgtgtagcccctttttaacctagtgttcattcaaaaaaaaattgatgcaaatctttattcactttcactggtgcacactgaaattttacttgaacagttctcataataaagcacttgtcttttgctcttta

SEQ ID NO: 323020 - DNA, 4699 bp, Homo sapiens
  misc_feature (517)..(517): n is a, c, g, or t
  misc_feature (562)..(562): n is a, c, g, or t
  misc_feature (636)..(636): n is a, c, g, or t
cgcccgctgctccgcgcgcagccggctcgggccgctcctcctgactgaggcgcggcggcggcggtggctgtgaccgcgcggaccgagccgagacattcgcgccgggggatcgggcgccgccgccgctgggccccgggcgcgtggatgcggctgggtcgggcggcgccgtacacctgaggcggagaacggggcgcggcgcgggtgacgctgtcagggccgcggttcctgacgcccaggcgctcgccaggacgagccaggcagtgatttgaggcaccggcttcaccttcacccatggtccggagagcctagcggggctcgccaccgcctcccggctccccttccacgcctcatcctgccagcctcgccgccccgccagcgccgggcaaccgcctcgcccgaagccctccctcgttactgtccgcataccccggcggcgccgccgcgggaagcggctccccctcctcttcctccgcgtcctcttccctctttcccccgccggggccgcttgttgcaccgncccgcggcctgcgggagccgctcgccccggccttgtgctcgcgtncgcacccctttcctgtcgccccccggggcccgcaccacagcccggccggcgagaccccggccagaccccgctgnccgcacaaaatgtcggcccggacgccattgccgacggtgaacgagcgggacacggaaaatcatacatctgtggatggatatactgaaccacacatccagcctaccaagtcgagtagcagacagaacatcccccggtgtagaaactccattacgtcagcaacagatgaacagcctcacattggaaattaccgtttacaaaaaacaatagggaagggaaattttgccaaagtcaaattggcaagacacgttctaactggtagagaggttgctgtgaaaataatagacaaaactcagctaaatcctaccagtctacaaaagttatttcgagaagtacgaataatgaagatactgaatcatcctaatatagtaaaattgtttgaagttattgaaacagagaagactctctatttagtcatggaatacgcgagtgggggtgaagtatttgattacttagttgcccatggaagaatgaaagagaaagaggcccgtgcaaaatttaggcagattgtatctgctgtacagtattgtcatcaaaagtacattgttcaccgtgatcttaaggctgaaaaccttctccttgatggtgatatgaatattaaaattgctgactttggttttagtaatgaatttacagttgggaacaaattggacacattttgtggaagcccaccctatgctgctcccgagcttttccaaggaaagaagtatgatgggcctgaagtggatgtgtggagtctgggcgtcattctctatacattagtcagtggctccttgcctttcgatggccagaatttaaaggaactgcgagagcgagttttacgagggaagtaccgtattcccttctatatgtccacagactgtgaaaatcttctgaagaaattattagtcctgaatccaataaagagaggcagcttggaacaaataatgaaagatcgatggatgaatgttggtcatgaagaggaagaactaaagccatatactgagcctgatccggatttcaatgacacaaaaagaatagacattatggtcaccatgggctttgcacgagatgaaataaatgatgccttaataaatcagaagtatgatgaagttatggctacttatattcttctaggtagaaaaccacctgaatttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatgctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtaacaatgtgtattctggaggtagcatggcaagaaggaatacatatgtctgtgaaaggaccacagatcgatacgtagcattgcagaatggaaaagacagcagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctggtacaacccagagagtgcctgctgcttccccatctgctcacagtattagtactgcgactccagaccggacccgttttccccgagggagctcaagccgaagcactttccatggtgaacagctccgggagcgacgcagcgttgcttataatgggccacctgcttcaccatcccatgaaacgggtgcatttgcacatgccagaaggggaacgtcaactggtataataagcaaaatcacatccaaatttgttcgcagaagtacatcaggggaaccaaaagaaagagacaaggaagagggtaaagattctaagccgcgttctttgcggttcacatggagtatgaagaccactagttcaatggaccctaatgacatgatgagagaaatccgaaaagtgttagatgcaaataactgtgattatgagcaaaaagagagatttttgcttttctgtgtccatggagacgctagacaggatagcctcgtgcagtgggagatggaagtctgcaagttgccacgactgtcacttaatggggttcgcttcaagcgaatatctgggacatctattgcctttaagaacattgcatcaaaaatagcaaatgagcttaagctgtaaagaagtccaaatttacaggttcagggaagatacatacatatatgaggtacagtttttgaatgtactggtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaaaaacttgtatagttgtctagatttctgcacctgaatgtatgtttgatgctttgatttgaaaatgttcttccctgttatttacattctggtgggtttttaaaattcttacctccatcatgcaattttgaaaattgtgtccagaattaaaagtgcatagaaatagcctttacaattgtagcatggacctttaaaaattgttttaaaatcttatttaaatttaaaccagaagctgaaaaatagatcagctttattatacacaaaattattactgcttatctttgctcttttccttgttatcccgcaaggtttagttgagaagatacaaaatgtttacagtgttggcacttagagtttttaaattcaagtacatgaaattcagtaatagcattgccttgagctaactaggaagtaccgggaaaaaagttaaatctacatcaagtttcttttgaactttgaagtgttttctgacccactgctaactgtagcaacaaaatttaaaagaaaattcagaataccgcaatttaattgcgggaatataataatattgggactgtttcacagcacaaactcatctttacagtgttgatcaatgcatcagttaagaaataatgccacctcaggaattaactggcattgggaacatttgcctcattctcctgctatcctcttcattcacccctgccactgtaatatctataagtacttaagagacttgtgagcaaaacatactatttataacagtatatgattgatttatgcttatgtggttgttcagtttgttcccatgtaactcgtttgttttaaatattttgccagatttcttgtatttattccacatcattatgcctataatgtgccgctttgtgattgggcatttgcctacttttctttcataattagtgatatatgcgatgtaaaaccactagtaaaggtacattttaatacttgttattttatactgaattagccttggaggttgactgtgcaatgttatttactgttgtaattactgtaataccaacatatgggccccatctgcacactcctgaaaaacagaaagtgtattcaaattttatcagtttaaagaaaataaagctgtgataaatactgtaattccaacctacattagaaggtctaagtgtaggtgatgtgccattccataatggcttccagactagggtgaattttatgttctgtactgtactgtgatgtagctttcttctgtaacagttatgttttaaaattaagtgagttttttttttgccttagcaaagggtggtgtttgaaaaaaaaaatgtgtagcccctttttaacctagtgttcattcaaaaaaaaattgatgcaaatctttattcactttcactggtgcacactgaaattttacttgaacagttctcataataaagcacttgtcttttgctcttta

SEQ ID NO: 323021 - DNA, 291 bp, Homo sapiens
atttgcacatgccagaaggggaacgtcaactggtataataagcaaaatcacatccaaatttgttcgcaggtcagtaccaatgtactgtcgtgttttgattcctctagaaattataaaggaaactagactttttaaaaaaatctttataataattttctaaaatggtttcataacatttcattagagctgctcttttacagagttggaagaaaaaaatctaggaagacataaagtatttttccttaagagagagaaaggaaaaaatggacaaaatgagattttaaaaatctg

SEQ ID NO: 323022 - DNA, 4753 bp, Homo sapiens
  misc_feature (517)..(517): n is a, c, g, or t
  misc_feature (562)..(562): n is a, c, g, or t
  misc_feature (636)..(636): n is a, c, g, or t
cgcccgctgctccgcgcgcagccggctcgggccgctcctcctgactgaggcgcggcggcggcggtggctgtgaccgcgcggaccgagccgagacattcgcgccgggggatcgggcgccgccgccgctgggccccgggcgcgtggatgcggctgggtcgggcggcgccgtacacctgaggcggagaacggggcgcggcgcgggtgacgctgtcagggccgcggttcctgacgcccaggcgctcgccaggacgagccaggcagtgatttgaggcaccggcttcaccttcacccatggtccggagagcctagcggggctcgccaccgcctcccggctccccttccacgcctcatcctgccagcctcgccgccccgccagcgccgggcaaccgcctcgcccgaagccctccctcgttactgtccgcataccccggcggcgccgccgcgggaagcggctccccctcctcttcctccgcgtcctcttccctctttcccccgccggggccgcttgttgcaccgncccgcggcctgcgggagccgctcgccccggccttgtgctcgcgtncgcacccctttcctgtcgccccccggggcccgcaccacagcccggccggcgagaccccggccagaccccgctgnccgcacaaaatgtcggcccggacgccattgccgacggtgaacgagcgggacacggaaaatcatacatctgtggatggatatactgaaccacacatccagcctaccaagtcgagtagcagacagaacatcccccggtgtagaaactccattacgtcagcaacagatgaacagcctcacattggaaattaccgtttacaaaaaacaatagggaagggaaattttgccaaagtcaaattggcaagacacgttctaactggtagagaggttgctgtgaaaataatagacaaaactcagctaaatcctaccagtctacaaaagttatttcgagaagtacgaataatgaagatactgaatcatcctaatatagtaaaattgtttgaagttattgaaacagagaagactctctatttagtcatggaatacgcgagtgggggtgaagtatttgattacttagttgcccatggaagaatgaaagagaaagaggcccgtgcaaaatttaggcagattgtatctgctgtacagtattgtcatcaaaagtacattgttcaccgtgatcttaaggctgaaaaccttctccttgatggtgatatgaatattaaaattgctgactttggttttagtaatgaatttacagttgggaacaaattggacacattttgtggaagcccaccctatgctgctcccgagcttttccaaggaaagaagtatgatgggcctgaagtggatgtgtggagtctgggcgtcattctctatacattagtcagtggctccttgcctttcgatggccagaatttaaaggaactgcgagagcgagttttacgagggaagtaccgtattcccttctatatgtccacagactgtgaaaatcttctgaagaaattattagtcctgaatccaataaagagaggcagcttggaacaaataatgaaagatcgatggatgaatgttggtcatgaagaggaagaactaaagccatatactgagcctgatccggatttcaatgacacaaaaagaatagacattatggtcaccatgggctttgcacgagatgaaataaatgatgccttaataaatcagaagtatgatgaagttatggctacttatattcttctaggtagaaaaccacctgaatttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatgctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtaacaatgtgtattctggaggtagcatggcaagaaggaatacatatgtctgtgaaaggaccacagatcgatacgtagcattgcagaatggaaaagacagcagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctggtacaacccagagagtgcctgctgcttccccatctgctcacagtattagtactgcgactccagaccggacccgttttccccgagggagctcaagccgaagcactttccatggtgaacagctccgggagcgacgcagcgttgcttataatgggccacctgcttcaccatcccatgaaacgggtgcatttgcacatgccagaaggggaacgtcaactggtataataagcaaaatcacatccaaatttgttcgcagaagtacatcaggggaaccaaaagaaagagacaaggaagagggtaaagattctaagccgcgttctttgcggttcacatggagtatgaagaccactagttcaatggaccctaatgacatgatgagagaaatccgaaaagtgttagatgcaaataactgtgattatgagcaaaaagagagatttttgcttttctgtgtccatggagacgctagacaggatagcctcgtgcagtgggagatggaagtctgcaagttgccacgactgtcacttaatggggttcgcttcaagcgaatatctgggacatctattgcctttaagaacattgcatcaaaaatagcaaatgagcttaagctgtaaagaagtccaaatttacaggttcagggaagatacatacatatatgaggtacagtttttgaatgtactggtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaaaaacttgtatagttgtctagatttctgcacctgaatgtatgtttgatgctttgatttgaaaatgttcttccctgttatttacattctggtgggtttttaaaattcttacctccatcatgcaattttgaaaattgtgtccagaattaaaagtgcatagaaatagcctttacaattgtagcatggacctttaaaaattgttttaaaatcttatttaaatttaaaccagaagctgaaaaatagatcagctttattatacacaaaattattactgcttatctttgctcttttccttgttatcccgcaaggtttagttgagaagatacaaaatgtttacagtgttggcacttagagtttttaaattcaagtacatgaaattcagtaatagcattgccttgagctaactaggaagtaccgggaaaaaagttaaatctacatcaagtttcttttgaactttgaagtgttttctgacccactgctaactgtagcaacaaaatttaaaagaaaaaaaacatactttatctggctattataacataaactgtcacgtaggtttgctgccttcagaataccgcaatttaattgcgggaatataataatattgggactgtttcacagcacaaactcatctttacagtgttgatcaatgcatcagttaagaaataatgccacctcaggaattaactggcattgggaacatttgcctcattctcctgctatcctcttcattcacccctgccactgtaatatctataagtacttaagagacttgtgagcaaaacatactatttataacagtatatgattgatttatgcttatgtggttgttcagtttgttcccatgtaactcgtttgttttaaatattttgccagatttcttgtatttattccacatcattatgcctataatgtgccgctttgtgattgggcatttgcctacttttctttcataattagtgatatatgcgatgtaaaaccactagtaaaggtacattttaatacttgttattttatactgaattagccttggaggttgactgtgcaatgttatttactgttgtaattactgtaataccaacatatgggccccatctgcacactcctgaaaaacagaaagtgtattcaaattttatcagtttaaagaaaataaagctgtgataaatactgtaattccaacctacattagaaggtctaagtgtaggtgatgtgccattccataatggcttccagactagggtgaattttatgttctgtactgtactgtgatgtagctttcttctgtaacagttatgttttaaaattaagtgagttttttttttgccttagcaaagggtggtgtttgaaaaaaaaaatgtgtagcccctttttaacctagtgttcattcaaaaaaaaattgatgcaaatctttattcactttcactggtgcacactgaaattttacttgaacagttctcataataaagcacttgtcttttgctcttta

SEQ ID NO: 323023 - DNA, 5215 bp, Homo sapiens
  misc_feature (517)..(517): n is a, c, g, or t
  misc_feature (562)..(562): n is a, c, g, or t
  misc_feature (636)..(636): n is a, c, g, or t
cgcccgctgctccgcgcgcagccggctcgggccgctcctcctgactgaggcgcggcggcggcggtggctgtgaccgcgcggaccgagccgagacattcgcgccgggggatcgggcgccgccgccgctgggccccgggcgcgtggatgcggctgggtcgggcggcgccgtacacctgaggcggagaacggggcgcggcgcgggtgacgctgtcagggccgcggttcctgacgcccaggcgctcgccaggacgagccaggcagtgatttgaggcaccggcttcaccttcacccatggtccggagagcctagcggggctcgccaccgcctcccggctccccttccacgcctcatcctgccagcctcgccgccccgccagcgccgggcaaccgcctcgcccgaagccctccctcgttactgtccgcataccccggcggcgccgccgcgggaagcggctccccctcctcttcctccgcgtcctcttccctctttcccccgccggggccgcttgttgcaccgncccgcggcctgcgggagccgctcgccccggccttgtgctcgcgtncgcacccctttcctgtcgccccccggggcccgcaccacagcccggccggcgagaccccggccagaccccgctgnccgcacaaaatgtcggcccggacgccattgccgacggtgaacgagcgggacacggaaaatcatacatctgtggatggatatactgaaccacacatccagcctaccaagtcgagtagcagacagaacatcccccggtgtagaaactccattacgtcagcaacagatgaacagcctcacattggaaattaccgtttacaaaaaacaatagggaagggaaattttgccaaagtcaaattggcaagacacgttctaactggtagagaggttgctgtgaaaataatagacaaaactcagctaaatcctaccagtctacaaaagttatttcgagaagtacgaataatgaagatactgaatcatcctaatatagtaaaattgtttgaagttattgaaacagagaagactctctatttagtcatggaatacgcgagtgggggtgaagtatttgattacttagttgcccatggaagaatgaaagagaaagaggcccgtgcaaaatttaggcagattgtatctgctgtacagtattgtcatcaaaagtacattgttcaccgtgatcttaaggctgaaaaccttctccttgatggtgatatgaatattaaaattgctgactttggttttagtaatgaatttacagttgggaacaaattggacacattttgtggaagcccaccctatgctgctcccgagcttttccaaggaaagaagtatgatgggcctgaagtggatgtgtggagtctgggcgtcattctctatacattagtcagtggctccttgcctttcgatggccagaatttaaaggaactgcgagagcgagttttacgagggaagtaccgtattcccttctatatgtccacagactgtgaaaatcttctgaagaaattattagtcctgaatccaataaagagaggcagcttggaacaaataatgaaagatcgatggatgaatgttggtcatgaagaggaagaactaaagccatatactgagcctgatccggatttcaatgacacaaaaagaatagacattatggtcaccatgggctttgcacgagatgaaataaatgatgccttaataaatcagaagtatgatgaagttatggctacttatattcttctaggtagaaaaccacctgaatttgaaggtggtgaatcgttatccagtggaaacttgtgtcagaggtcccggcccagtagtgacttaaacaacagcactcttcagtcccctgctcacctgaaggtccagagaagtatctcagcaaatcagaagcagcggcgtttcagtgatcatgctggtccatccattcctcctgctgtatcatataccaaaagacctcaggctaacagtgtggaaagtgaacagaaagaggagtgggacaaagatgtggctcgaaaacttggcagcacaacagttggatcaaaaagcgagatgactgcaagccctcttgtagggccagagaggaaaaaatcttcaactattccaagtaacaatgtgtattctggaggtagcatggcaagaaggaatacatatgtctgtgaaaggaccacagatcgatacgtagcattgcagaatggaaaagacagcagccttacggagatgtctgtgagtagcatatcttctgcaggctcttctgtggcctctgctgtcccctcagcacgaccccgccaccagaagtccatgtccacttctggtcatcctattaaagtcacactgccaaccattaaagacggctctgaagcttaccggcctggtacaacccagagagtgcctgctgcttccccatctgctcacagtattagtactgcgactccagaccggacccgttttccccgagggagctcaagccgaagcactttccatggtgaacagctccgggagcgacgcagcgttgcttataatgggccacctgcttcaccatcccatgaaacgggtgcatttgcacatgccagaaggggaacgtcaactggtataataagcaaaatcacatccaaatttgttcgcagaagtacatcaggggaaccaaaagaaagagacaaggaagagggtaaagattctaagccgcgttctttgcggttcacatggagtatgaagaccactagttcaatggaccctaatgacatgatgagagaaatccgaaaagtgttagatgcaaataactgtgattatgagcaaaaagagagatttttgcttttctgtgtccatggagacgctagacaggatagcctcgtgcagtgggagatggaagtctgcaagttgccacgactgtcacttaatggggttcgcttcaagcgaatatctgggacatctattgcctttaagaacattgcatcaaaaatagcaaatgagcttaagctgtaaagaagtccaaatttacaggttcagggaagatacatacatatatgaggtacagtttttgaatgtactggtaatgcctaatgtggtctgcctgtgaatctccccatgtagaatttgcccttaatgcaataaggttatacatagttatgaactgtaaaattaaagtcagtatgaactataataaatatctgtagcttaaaaagtaggttcacatgtacaggtaagtatattgtgtatttctgttcattttctgttcatagagttgtataataaaacatgattgcttaaaaacttgtatagttgtctagatttctgcacctgaatgtatgtttgatgctttgatttgaaaatgttcttccctgttatttacattctggtgggtttttaaaattcttacctccatcatgcaattttgaaaattgtgtccagaattaaaagtgcatagaaatagcctttacaattgtagcatggacctttaaaaattgttttaaaatcttatttaaatttaaaccagaagctgaaaaatagatcagctttattatacacaaaattattactgcttatctttgctcttttccttgttatcccgcaaggtttagttgagaagatacaaaatgtttacagtgttggcacttagagtttttaaattcaagtacatgaaattcagtaatagcattgccttgagctaactaggaagtaccgggaaaaaagttaaatctacatcaagtttcttttgaactttgaagtgttttctgacccactgctaactgtagcaacaaaatttaaaagaaaaaaaacatactttatctggctattataacataaactgtcacgtaggtttgctgccttcagaataccgcaatttaattgcgggaatataataatattgggactgtttcacagcacaaactcatctttacagtgttgatcaatgcatcagttaagaaataatgccacctcaggaattaactggcattgggaacatttgcctcattctcctgctatcctcttcattcacccctgccactgtaatatctataagtacttaagagacttgtgagcaaaacatactatttataacagtatatgattgatttatgcttatgtggttgttcagtttgttcccatgtaactcgtttgttttaaatattttgccagatttcttgtatttattccacatcattatgcctataatgtgccgctttgtgattgggcatttgcctacttttctttcataattagtgatatatgcgatgtaaaaccactagtaaaggtacattttaatacttgttattttatactgaattagccttggaggttgactgtgcaatgttatttactgttgtaattactgtaataccaacatatgggccccatctgcacactcctgaaaaacagaaagtgtattcaaattttatcagtttaaagaaaataaagctgtgataaatactgtaattccaacctacattagaaggtctaagtgtaggtgatgtgccattccataatggcttccagactagggtgaattttatgttctgtactgtactgtgatgtagctttcttctgtaacagttatgttttaaaattaagtgagttttttttttgccttagcaaagggtggtgtttgaaaaaaaaaatgtgtagcccctttttaacctagtgttcattcaaaaaaaaattgatgcaaatctttattcactttcactggtgcacactgaaattttacttgaacagttctcataataaagcacttgtcttttgctctttatcagaatgtgaattacctgttttctggtacaaaagtattctgtatgaggagtttattgtatgtgttctaaatttagttggcaaagggtgaagctgtgaaggttttcaagattattgaaactatgaaggtttcttgtcattatgacaagaaagtttaatctttttataggaattcctgtcactgaaatacgtttttaaaaaaatagactcatgtgttttccacggtagaaactgatatttttttacattttctcactgtggccaactcttctgtgtttgtagaaaggaatttgacttcaatatcttttatgaactaaaaatgaaatcttgatactcactttagatttttcattttatgtgttcatgacaacataaatatttttcaaagatttagaggaattttgcaatgtgtttgcataaataaataccagtttatgttcaccggctatgtgataccaggatt

SEQ ID NO: 323024 - DNA, 501 bp, Homo sapiens
gaagttttttgggctccctcatagtagattctaaccagaaatttaacctaagacactcaagccatttacaaaacaaagtataaatcacgttctgtcacttacaatcacataaaatgtctgatatatagaaatattttaacaccagtagtaaatatagctatcacatttgtagatgtaaattgatcacaaaaaaaatttttgcacagtactattagtttttgttccctgtgaaaaataaaccacagaaacaaacatatgggttaaatactttactgtcatttaatggaaagaaaaagttatttctgatgtctgagacaaggaaaaaaattcctatagtgctcccaattttaaaagaaatcattctagtcttttgaatttaataattaaatagcagaactgaattttcagagtttatgtaagaaacaagggacactagactctttttgttcactatttttattggctatgaagcaataaactgcaccagtattttttaaagtt

SEQ ID NO: 323025 - DNA, 255 bp, Homo sapiens
ctttattggggtataactgataaataaaaatcctataatttcaaggtatatgttttgatatacattgtgaaataccttccacaatcgaatgaattaacatgtcagtcacctcacagttacctttttttgtaggtatagtaagaacaaatttcaagtatgcaatacattattaatatggttaggctttgtgtctccacccaaatcttatcttgaattataatccccataatccacacgtgtcgagagagagagacc

SEQ ID NO: 323026 - DNA, 473 bp, Homo sapiens
ttcaagctattctcctgccacagcctcctgagtagccgggactacaggtgtgcaccaccacacctggctaacttttttgtatttttagtagagatagggtttcaccatgttggtcaggctggtctcaacacctaacctcaaatgatccacccagctcggcatcccaaagtactgggattacaggcgtgagccatcgcatgcagccgctttagccctttttatagatgagcaaacagacccagaaaagtaagtcatcgctcaagggacacagccggtaaataggactggaactgttcagctctttggctctgatcaggattacaactttgcagaccctttgtctagattctaaatgcccaagtgcattttccagaaaaacatccattaatggtagatagggttatcaccatcacctactgttttactttgctaggggcgtcatgacaatgtacgacagactgagtggcttaaac

SEQ ID NO: 323027 - DNA, 192 bp, Homo sapiens
caaatgaggtgaattctttcttccagtttgttgattctatcttctgttatctcattctactactcaacccatccgtgatatttttctttctgttgttgtatttctcatttccataacatccatttggtacttttgcataacttttatttctttgttgagattatccatttgtgacagagattgttcaggaat

SEQ ID NO: 323028 - DNA, 2320 bp, Homo sapiens
tgagacagagtttcactttgttgcccaggctggagtgtagtggcatgatctcagctcactgcaacctccacctccctggttcaagtgatatttgtgcctcagccccctgaatagctaggattacaggcgtgggccaccacgcctggttaatctctgtatttttagtagaggtagagtttcaccattttggccaggctggtttcgaactcctggcctcaagtgatctgccaccttggcctcccaaagtgctgggaatacaggcgtgagccactgtgcccgccctgatgagatattttattaccaatgttagtattgagaaactgaaatgtttgaagaagcacaacccaggatcgtgctggtagcaccacagtacttaaactgttggtcaattaaggccagaaagggaaattgttaatttagctctggtgctttggtttacaggaacataactcttaactgacatctgacatcatgatagccatatgtgctcagctctgggtagagtttctgcagttactcatctgaactaatgaacaataactgaccactagtcactttatgccgtgtaactagctctaggccatactttcactggttactggtgtgaaagctgaaattcattttgttacattctggtgaagacccctcttgataatgggaatgttttaactctcttgatgaaaaaataatctgtatttgtgttgatgttcacatttctgtagcacatttcttatccttttggttgaatgaaaagatcttgtataggggtgtggagatggggagtgggtagaagtgtgtgaaggacgctttgcatttgggatctgttcacaaacagccatatgagtgtgttaatgaatgtcagccagttaccaaccctgctggttgttatgggttgttttgagaagttggcaaccaggcatctaagatgttgcctggtacaggcctcttttcttccctgaggcccatgacatttctctgttactctagagggtttctcagatggccagtaggctcctccctgcttagggtctcatttctctgaaaagaggatgaactgaaaagcaggtagttccagaagctaattgctgctttccatcataattatttttcttgtgagaacatttctcttttaattagctagtgattttgattaagactaattcactaaacatacccttccctcaaatcacctcaggtagcaatctgtaagtaactaaaagcattgaaaaacacacaagaaacatttttaaaaactatttttaaaggcctggccgggtgcagtggctcactcctgtaatcccagcactttgggaggccgagacgggtggatcacctgaggtcaggaatttgagactagcatggccaacatggtgaaaccccgtgtctactaaaaatacaaaaattagctgggcgtggtggcagacgcctgtaatcccagctactcagggaggctgaggcacgagaatcgcttgaacctgggaggcggaggttgcagtgagccaagattgcgccactgcactccaacctgggtgacaagagcaagactccgtctcacaaaaaacaaacaaaactgactgattgaatatactaaaccaaactaaaatcatattcttttgattaagtttatccatggctgtattcttctatgaattcttccatttaattcttccacgattatcttctcctgtaaatacatcacaggagttagaattctctacccatcagctgtaccatgtcgcagaattcatgcaggcacaaagttggagttacagagatgggttgacagcaggcaaacttggcctatgtattataaccacaacttcaagttcttacctcatgtgaatattcaccctttctttagtcttccaaggcaaacagccccgtctcatcaccagatgagcaaggtcttgatatggcatagcagatctccctagacacagatcatgagaaaagatggaagagacttagggattcaggcatcagatgaagttggcttttcccttttatgccttgtttgtatttaccctgtctaatacactaaggatacttactcattgtacttgcagctcaatatgtctttgctgttcagatactaaaatgtacctctgagtcattgtgagctgtgtggtaggttggacattggcatagttggtgatgggactcaaaatgaaaaggtggtctctttaccaggtcacagactgtagcagattgtgcttgttatctgacaatgactgtcactttgagggtcgttgatttgcatgcactactctggggccttgtattggagccttttttaaaaaaaataaaatctgagatagag

SEQ ID NO: 323029 - DNA, 430 bp, Homo sapiens
agaagaaaaagggaggaaggaatgagtgcatggtccagggtagagagatggggctagacccaaaatcaagtggagggcagtgggttagcctcgaaatccataagaacccttcttctgatgcgatggaagagaggataggggaaatggaaaaaaaaaagatgtgatcagaagggatacgaattgagtaagttcactgcaggcggtctgcattgatttatcagtagagtaagaagcagtgaaaggaaattcacagacaagtaactcaggctcctgagaggatggctctggggattattgtcatggaggaaaaatttgaaagaatgacagaagtctctcatctgaacaatacaaactgacacatttgccagaatgtgtctcgaggcaggaagttggtttattgaagtggaaagtagtggttataaaaaaaaaa

SEQ ID NO: 323030 - DNA, 3312 bp, Homo sapiens
agtatgttttgcagacaagacccagagaagtccagactggacttgttgcagactgcaaaactgccattggaaggcctccgtcccagtccttctacagagtagccagtgggactcccagccatgggcgaggtgacagcagaggaggtggagaagttcctggactcgaatattggctttgccaaacagtactacaacctccactaccgggccaagctcatctccgacctccttggggccaaggaggctgccgtggacttcagcaactaccactccccgagcagcatggaggagagcgaaatcatctttgatctcctgcgggactttcaggagaatttacagacagagaaatgcatcttcaatgtcatgaagaagctgtgcttcctcctgcaggcagaccgcatgagcctgttcatgtaccggacccgcaatggcatcgcagagctggccaccaggcttttcaatgtccacaaggatgctgtcctcgaggactgcctggtgatgcccgaccaagagatcgtcttccctttggacatgggcatcgtgggccatgtcgcacactctaagaagattgctaacgtccccaacacagaggaggatgagcatttctgtgactttgtggacatcctcacagagtacaagaccaagaacatcttggcttcccccataatgaatgggaaggatgtggtggccataatcatggctgtgaataaagtggatggatcccacttcaccaagagagatgaagagattcttctcaagtacctcaattttgcaaatctaatcatgaaggtgtaccacctgagttacctgcacaactgtgaaactcgacgtggccagatactgctgtggtctgggagcaaagtctttgaagaacttacggacatcgaacgacagttccacaaagccctgtacacagtccgtgctttcctcaactgtgacagatactctgtgggtctcttagacatgaccaagcagaaggaattttttgatgtgtggccggttctgatgggtgaagttccaccttactctggtcccaggactccggatggaagagaaattaacttttacaaggtcattgactacatcctgcatggcaaagaggacatcaaagtcatcccgaatccacctcctgaccattgggctttagtaagcggtctcccagcttatgttgcccagaatggcctgatttgcaacatcatgaatgcgcctgcggaggacttttttgcatttcagaaagaacctctggatgagtctggatggatgattaaaaatgtgctttcaatgccgattgtgaacaagaaggaagaaattgttggagtggccacattttacaatcgtaaagatgggaagccctttgatgaaatggatgagacgctcatggagtctttgactcaatttctgggctggtctgtcttaaatcctgacacctatgagtcaatgaataaacttgaaaataggaaggatattttccaggacatagtaaaatatcatgtgaagtgtgacaatgaagaaattcagaaaatcttgaaaaccagagaggtgtatgggaaggagccatgggagtgtgaggaagaggagctggctgagatcctgcaagcggagctgccagatgcagataaatacgaaattaataaatttcacttcagtgacttacccctaacagaactggagctggtaaaatgtggaatacagatgtattatgagctcaaagtggtggataaatttcacattccacaagaggccctggtgcggttcatgtactccctgagtaagggctaccgcaagatcacctaccacaactggcggcacggcttcaacgtggggcagaccatgttctccctgctggtgacgggaaagctgaagcgctacttcacggacctagaggccttggccatggtcactgctgctttctgccatgacattgaccacagaggcaccaataacctctaccagatgaaatcccagaacccactggccaagctccatgggtcctctatcttggaaagacaccacttggagtttggcaaaacactgctcagagacgagagcctgaatatctttcaaaacctcaatcgtcgacagcatgagcatgccatccacatgatggacattgcaatcattgccacagacctcgccctgtatttcaagaagaggacgatgttccaaaagatcgtggatcagtctaagacatatgagagtgaacaggagtggacacagtacatgatgctggagcagacacggaaggaaatcgttatggccatgatgatgaccgcctgtgatctctcagccatcaccaaaccctgggaggtgcagagccaggtagctctgctggtggctgctgaattctgggaacaaggtgacctggagcgcacggtgctgcaacagaatcccattcccatgatggacagaaacaaagcagatgaactccctaagcttcaagtcggcttcattgactttgtttgcaccttcgtctacaaggaattctcccgtttccacgaggagatcaccccaatgttggacgggatcaccaacaatcgcaaggagtggaaggcgcttgctgatgagtacgatgccaagatgaaggtgcaggaggagaagaagcagaaacagcagtcggccaagtcagcagccgcaggaaatcagccggggggaaaccccagcccagggggtgcaactacatccaagtcctgctgcatccagtaacaccactggggatgtgctggctggacggcaccaccctttcctgggaagagatgactcaagccagtggaagaccacacaccttgagaagtagaagagtcataggatttgaaagctgttagagaatttagcttccaggactgttcaatcttttggcttccctgggccacattggaagaattgtcttgggtcacacataaaatacagtaacactaatgatagctgttgaacttaaaaaaaaaaatcgccaaaaaaaaaaatttcataatgttttaagaaagtttatgaatttgtgttgggccgcattcaaagccgtcctgggctgcatgtggcccacgggccgtgggttgaacaagcttggcttataccttatccagtggcttttaaacattcttttagtcttgagaactgcctattgagctaaaaccaatattctagctttcatagacatcagttaaacatttaattacatttaattaatgccagattcactggcttgcttagaatcatttttgttcttatactttcagttaatgtattgtaaaaattttcaatcattttcaaaagtagagaattgtacgttgaatccccacatacccatcacccagattc

SEQ ID NO: 323031 - DNA, 2242 bp, Homo sapiens
agaatgtgaatgccttggacaagaacatggtgtttctgaaaatggtatacagtgcttcactgggcaccctctcaggcctaatcacaccttcattattccccttcactgctctcagatttgcaacatcatgaatgcgcctgcggaggacttttttgcatttcagaaagaacctctggatgagtctggatggatgattaaaaatgtgctttcaatgccgattgtgaacaagaaggaagaaattgttggagtggccacattttacaatcgtaaagatgggaagccctttgatgaaatggatgagacgctcatggagtctttgactcaatttctgggctggtctgtcttaaatcctgacacctatgagtcaatgaataaacttgaaaataggaaggatattttccaggacatagtaaaatatcatgtgaagtgtgacaatgaagaaattcagaaaatcttgaaaaccagagaggtgtatgggaaggagccatgggagtgtgaggaagaggagctggctgagatcctgcaagcggagctgccagatgcagataaatacgaaattaataaatttcacttcagtgacttacccctaacagaactggagctggtaaaatgtggaatacagatgtattatgagctcaaagtggtggataaatttcacattccacaagaggccctggtgcggttcatgtactccctgagtaagggctaccgcaagatcacctaccacaactggcggcacggcttcaacgtggggcagaccatgttctccctgctggtgacgggaaagctgaagcgctacttcacggacctagaggccttggccatggtcactgctgctttctgccatgacattgaccacagaggcaccaataacctctaccagatgaaatcccagaacccactggccaagctccatgggtcctctatcttggaaagacaccacttggagtttggcaaaacactgctcagagacgagagcctgaatatctttcaaaacctcaatcgtcgacagcatgagcatgccatccacatgatggacattgcaatcattgccacagacctcgccctgtatttcaagaagaggacgatgttccaaaagatcgtggatcagtctaagacatatgagagtgaacaggagtggacacagtacatgatgctggagcagacacggaaggaaatcgttatggccatgatgatgaccgcctgtgatctctcagccatcaccaaaccctgggaggtgcagagccaggtagctctgctggtggctgctgaattctgggaacaaggtgacctggagcgcacggtgctgcaacagaatcccattcccatgatggacagaaacaaagcagatgaactccctaagcttcaagtcggcttcattgactttgtttgcaccttcgtctacaaggaattctcccgtttccacgaggagatcaccccaatgttggacgggatcaccaacaatcgcaaggagtggaaggcgcttgctgatgagtacgatgccaagatgaaggtgcaggaggagaagaagcagaaacagcagtcggccaagtcagcagccgcaggaaatcagccggggggaaaccccagcccagggggtgcaactacatccaagtcctgctgcatccagtaacaccactggggatgtgctggctggacggcaccaccctttcctgggaagagatgactcaagccagtggaagaccacacaccttgagaagtagaagagtcataggatttgaaagctgttagagaatttagcttccaggactgttcaatcttttggcttccctgggccacattggaagaattgtcttgggtcacacataaaatacagtaacactaatgatagctgttgaacttaaaaaaaaaaatcgccaaaaaaaaaaatttcataatgttttaagaaagtttatgaatttgtgttgggccgcattcaaagccgtcctgggctgcatgtggcccacgggccgtgggttgaacaagcttggcttataccttatccagtggcttttaaacattcttttagtcttgagaactgcctattgagctaaaaccaatattctagctttcatagacatcagttaaacatttaattacatttaattaatgccagattcactggcttgcttagaatcatttttgttcttatactttcagttaatgtattgtaaaaattttcaatcattttcaaaagtagagaattgtacgttgaatccccacatacccatcacccagattc

SEQ ID NO: 323032 - DNA, 1088 bp, Homo sapiens
agtatgttttgcagacaagacccagagaagtccagactggacttgttgcagactgcaaaactgccattggaaggcctccgtcccagtccttctacagagtagccagtgggactcccagccatgggcgaggtgacagcagaggaggtggagaagttcctggactcgaatattggctttgccaaacagtactacaacctccactaccgggccaagctcatctccgacctccttggggccaaggaggctgccgtggacttcagcaactaccactccccgagcagcatggaggagagcgaaatcatctttgatctcctgcgggactttcaggagaatttacagacagagaaatgcatcttcaatgtcatgaagaagctgtgcttcctcctgcaggcagaccgcatgagcctgttcatgtaccggacccgcaatggcatcgcagagctggccaccaggcttttcaatgtccacaaggatgctgtcctcgaggactgcctggtgatgcccgaccaagagatcgtcttccctttggacatgggcatcgtgggccatgtcgcacactctaagaagattgctaacgtccccaacacagaggaggatgagcatttctgtgactttgtggacatcctcacagagtacaagaccaagaacatcttggcttcccccataatgaatgggaaggatgtggtggccataatcatggctgtgaataaagtggatggatcccacttcaccaagagagatgaagagattcttctcaagtacctcaattttgcaaatctaatcatgaaggtgtaccacctgagttacctgcacaactgtgaaactcgacgtggccagatactgctgtggtctgggagcaaagtctttgaagaacttacggacatcgaacgacagttccacaaagccctgtacacagtccgtgctttcctcaactgtgacagatactctgtgggtctcttagacatgaccaagcagaaggaattttttgatgtgtggccggttctgatgggtgaagttccaccttactctggtcccaggactccggatggaagagtacgttctctctgaccttttcagtatgatttaat

SEQ ID NO: 323033 - DNA, 489 bp, Homo sapiens
tcacttgtggagaaggctgaagactgagtcaggagacttgatgtttagtcctaattttctattgtccactccatattgattctctctctttctcattcagatcccagaacccactggccaagctccatgggtcctctatcttggaaagacaccacttggagtttggcaaaacactgctcagagacgaggtaggatgagggccaagggtctacaggccgcggggcctggatcagaggctctatttcacaaggagcctgagtgtgcccagggagcattcttcccattggcctgggctgcctctgccatcatctggggtggccattggtaggtgggtgactttactgccagcatcaattctctcccatctcgcttctctttttttctttagagcctgaatatctttcaaaacctcaatcgtcgacagcatgagcatgccatccacatgatggacattgcaatcattgccacagacctcgccctgtatttcaa

SEQ ID NO: 323034 - DNA, 244 bp, Homo sapiens
ggggaagcccactgcagcctcttgtcacctggtgtgttctttttcctgtttcattgcagcagccgcaggaaatcagccggggggaaaccccagcccagggggtgcaactacatccaagtcctgctgcatccagtaacaccactggggatgtgctggctggacggcaccaccctttcctgggaagagatgactcaagccagtggaagaccacacaccttgagaagtagaagagtcataggatttg

SEQ ID NO: 323035 - DNA, 1555 bp, Homo sapiens
gaaatgtttcactttgaccaaggtctgcaaaataatggggagcttacaaaatggtgcagttgggactaacaccaggtagccgagaccacagacgggaaagctgaagcgctacttcacggacctagaggccttggccatggtcactgctgctttctgccatgacattgaccacagaggcaccaataacctctaccagatgaaatcccagaacccactggccaagctccatgggtcctctatcttggaaagacaccacttggagtttggcaaaacactgctcagagacgagagcctgaatatctttcaaaacctcaatcgtcgacagcatgagcatgccatccacatgatggacattgcaatcattgccacagacctcgccctgtatttcaagaagaggacgatgttccaaaagatcgtggatcagtctaagacatatgagagtgaacaggagtggacacagtacatgatgctggagcagacacggaaggaaatcgttatggccatgatgatgaccgcctgtgatctctcagccatcaccaaaccctgggaggtgcagagccaggtagctctgctggtggctgctgaattctgggaacaaggtgacctggagcgcacggtgctgcaacagaatcccattcccatgatggacagaaacaaagcagatgaactccctaagcttcaagtcggcttcattgactttgtttgcaccttcgtctacaaggaattctcccgtttccacgaggagatcaccccaatgttggacgggatcaccaacaatcgcaaggagtggaaggcgcttgctgatgagtacgatgccaagatgaaggtgcaggaggagaagaagcagaaacagcagtcggccaagtcagcagccgcaggaaatcagccggggggaaaccccagcccagggggtgcaactacatccaagtcctgctgcatccagtaacaccactggggatgtgctggctggacggcaccaccctttcctgggaagagatgactcaagccagtggaagaccacacaccttgagaagtagaagagtcataggatttgaaagctgttagagaatttagcttccaggactgttcaatcttttggcttccctgggccacattggaagaattgtcttgggtcacacataaaatacagtaacactaatgatagctgttgaacttaaaaaaaaaaatcgccaaaaaaaaaaatttcataatgttttaagaaagtttatgaatttgtgttgggccgcattcaaagccgtcctgggctgcatgtggcccacgggccgtgggttgaacaagcttggcttataccttatccagtggcttttaaacattcttttagtcttgagaactgcctattgagctaaaaccaatattctagctttcatagacatcagttaaacatttaattacatttaattaatgccagattcactggcttgcttagaatcatttttgttcttatactttcagttaatgtattgtaaaaattttcaatcattttcaaaagtagagaattgtacgttgaatccccacatacccatcacccagattc

SEQ ID NO: 323036 - DNA, 2340 bp, Homo sapiens
agtatgttttgcagacaagacccagagaagtccagactggacttgttgcagactgcaaaactgccattggaaggcctccgtcccagtccttctacagagtagccagtgggactcccagccatgggcgaggtgacagcagaggaggtggagaagttcctggactcgaatattggctttgccaaacagtactacaacctccactaccgggccaagctcatctccgacctccttggggccaaggaggctgccgtggacttcagcaactaccactccccgagcagcatggaggagagcgaaatcatctttgatctcctgcgggactttcaggagaatttacagacagagaaatgcatcttcaatgtcatgaagaagctgtgcttcctcctgcaggcagaccgcatgagcctgttcatgtaccggacccgcaatggcatcgcagagctggccaccaggcttttcaatgtccacaaggatgctgtcctcgaggactgcctggtgatgcccgaccaagagatcgtcttccctttggacatgggcatcgtgggccatgtcgcacactctaagaagattgctaacgtccccaacacagaggaggatgagcatttctgtgactttgtggacatcctcacagagtacaagaccaagaacatcttggcttcccccataatgaatgggaaggatgtggtggccataatcatggctgtgaataaagtggatggatcccacttcaccaagagagatgaagagattcttctcaagtacctcaattttgcaaatctaatcatgaaggtgtaccacctgagttacctgcacaactgtgaaactcgacgtggccagatactgctgtggtctgggagcaaagtctttgaagaacttacggacatcgaacgacagttccacaaagccctgtacacagtccgtgctttcctcaactgtgacagatactctgtgggtctcttagacatgaccaagcagaaggaattttttgatgtgtggccggttctgatgggtgaagttccaccttactctggtcccaggactccggatggaagagaaattaacttttacaaggtcattgactacatcctgcatggcaaagaggacatcaaagtcatcccgaatccacctcctgaccattgggctttagtaagcggtctcccagcttatgttgcccagaatggcctgatttgcaacatcatgaatgcgcctgcggaggacttttttgcatttcagaaagaacctctggatgagtctggatggatgattaaaaatgtgctttcaatgccgattgtgaacaagaaggaagaaattgttggagtggccacattttacaatcgtaaagatgggaagccctttgatgaaatggatgagacgctcatggagtctttgactcaatttctgggctggtctgtcttaaatcctgacacctatgagtcaatgaataaacttgaaaataggaaggatattttccaggacatagtaaaatatcatgtgaagtgtgacaatgaagaaattcagaaaatcttgaaaaccagagaggtgtatgggaaggagccatgggagtgtgaggaagaggagctggctgagatcctgcaagcggagctgccagatgcagataaatacgaaattaataaatttcacttcagtgacttacccctaacagaactggagctggtaaaatgtggaatacagatgtattatgagctcaaagtggtggataaatttcacattccacaagaggccctggtgcggttcatgtactccctgagtaagggctaccgcaagatcacctaccacaactggcggcacggcttcaacgtggggcagaccatgttctccctgctggtgacgggaaagctgaagcgctacttcacggacctagaggccttggccatggtcactgctgctttctgccatgacattgaccacagaggcaccaataacctctaccagatgaaatcccagaacccactggccaagctccatgggtcctctatcttggaaagacaccacttggagtttggcaaaacactgctcagagacgagagcctgaatatctttcaaaacctcaatcgtcgacagcatgagcatgccatccacatgatggacattgcaatcattgccacagacctcgccctgtatttcaagaagaggacgatgttccaaaagatcgtggatcagtctaagacatatgagagtgaacaggagtggacacagtacatgatgctggagcagacacggaaggaaatcgttatggccatgatgatgaccgcctgtgatctctcagccatcaccaaaccctgggaggtgcagagccaggtatgaactcctgctgaccca

SEQ ID NO: 323037 - DNA, 603 bp, Homo sapiens
aggagaatttacagacagagaaatgcatcttcaatgtcatgaagaagctgtgcttcctcctgcaggcagaccgcatgagcctgttcatgtaccggacccgcaatggcatcgcagagctggccaccaggcttttcaatgtccacaaggatgctgtcctcgaggactgcctggtgatgcccgaccaagagatcgtcttccctttggacatgggcatcgtgggccatgtcgcacactctaagaagattgctaacgtccccaacacagaggaggtactctcttccccatgagagagagggcatggggcattattacatggagttctggggtacaggtggggtgaggggcattggccaccaagacaaggctggtgacaacatggtgcttcttctttatttatttacatatttactcataattctttattttgaaaaaaaaattcaaacttaacagaaaagtttgaaataatacagagaactgtatgtctttcatccaaatttatcattcattaacatcttgccacatttgctttctctctccattttctctgacccatttgggagaaagttgcagacatcatgccctttgtctgtaagtactggcgat

SEQ ID NO: 323038 - DNA, 2105 bp, Homo sapiens
ttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagaacgtgcacccacagccaccttccatgacagtaaacataacattgtgcatgtgcatttcgatgcaaccagaggatggttactgacttctggaactgacaaggttattaagttgtgggatatgaccccagtcgtgtcttgatgactctcccaggaatcagaaagatagtatttactaaagaaacggttgttttaacccaaatcattaccagagtggtaaagcagacatgtgagaagtaagaaagaaactaaagaccctgaatgaatttgcagattacccatgtgcacagtggggacctggccagtgagcactcgcaaggggactcttccaacttgttcatacaatataaaagaagctatttttttaacaaatggtttatacagtctggctgtgctgcattgttttgagtgtaccgaaaaatctgtgtggggtgtttaatttttatacttttcaacaccccattttacttgttgctttgtcagagaaataagggaggtatctactcagagtattttggtcattatactttctgtgtttacttcaacatgtgtcacgtggccagcggctttttcttctcttccctctgcacctacctgcaccttctctgcctttcctggaggggatgtatttatgttatttattcccagtgtttctgctttcatgtcctcctcagtggagagatttggaaactcatcatgtggattcaccagccagctgctggaattgcctgaagagcgatttgtttgtaatgtctgcctcattcacgttcttatgaagtagaaaagactgtgtttctgcctcagttgcctctgtctttcccacattaaaaaaaaaaatgctgtgagaaaaaag

SEQ ID NO: 323039 - DNA, 2338 bp, Homo sapiens
ttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagcctctgtggagctgcttcgtggttatgataagtgctgtgtgatgctcaccttgggaggtctgcgacatatattgaagtcatctctaacctgaagtactgacagactttctggaagaaaaggcttgtaggaggaaacttcagaattctattaaatggtgtaaatgatgaaattatagttgatatatgctagagcatcagtgctgggtattttagaagggatggagtcatcattggctaatgttcccagtgaaggattgagggaggaacattgtgctgaaggatcaacagagtctggatgtgctctgagcaggagcacatgggctttgcaggccacgaaacagcaagagtaaggacaaggtgaacacgataggttgatgcagtgcattaatgctcatgagcggtttagagaagcagtcagagatgagaggatggcagctagctgaaagataaggacagacaatggaagaccttgagtggctggatgtagatcgagtgacattgcataggttgaacaggtgttttatacagttaatgaaatccatttttgttttgttaacttttagcattttttaaaagtatatattgtatataacattcttggtagaaaagttacaaaatgctcattagtaaatagaaaagatgtcaattactcatactaccaccatccagaaatatcactctgaacatgttggcacacatccttcctaacatttttctctacacataacacgtgtgtaagacttttttttgaacaaaaaatagaatcacaaacatgctgatttattttttcccctttattggtctttagctcccaaatgcctcctcacagatacccactgtgatgtgtttgatgtgtgtcctgaacacgcatgcttccttataaaaggtgtgtgtgtgtgtgtatgtgtgtctgtgtgtgtgttttaaagtttacataactcagccgggcacggtggctcacgcctgtaatgccagctgttgggaggccaaggcaggtggatcacttgaggtcaagagtttgagaccagcctggtcaacatggcgaaaccctgtctctactaacaatacaaaaaaaaaagaggcaggagaattgcatgaacctaggaggcggaggttgcagtgagccaagatcgcaccactgcactccagcctgggcaacacagcaaggctgtctcaaataatatttagtgattccataatttttcgggtggggccgctctggcccagtcgattctatgttggagcaggcttttcatgcgggccattttggggttacttggccattcggcctatttgggtctttttcaattcaccgg

SEQ ID NO: 323040 - DNA, 1617 bp, Homo sapiens
ttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagaacgtgcacccacagccaccttccatgacagtaaacataacattgtgcatgtgcatttcgatgcaaccagaggatggttactgacttctggaactgacaaggttattaaggtaagatgccatcttattaagaagctttccatctttggcctcatataaatatacaggagcaccaagaacatgggaggcactgttctaaaggttatccttgggtagccggccatggtggcatgtgtctgtagtcccagctactcaggagatttaggagggaggattgcttgagtccaggagttgaaggctacagtgagctttgatcacatcactgcactctagcctgagcaacaaagcaagacctcatctctta

SEQ ID NO: 323041 - DNA, 2683 bp, Homo sapiens
gccctgtggttctggccctgcctcccttcctgcttatttcttatttcttttatgattaaaccatgaaataaggcatgtaacgttaaagaattgtagcataaaaggagttgtttgggttgttttttttttccctcacaagttggcatgtaacattactgtgatggagagttcataagaattttgactgagactaagctgtttaaatctgttacaccattcacagcaaaagtacaggtgaggaaaagaaaccatctatttcctggtgattagtcctttggtataaaatgcactacaaaaacggaggactcacgtgatttatgtcatggaagtagaaataattattttgtactttataagtcatgttctaaatagttccccagatatcaatatatccttagttttctagcacgtatttacatgttatcagaacattcttttttatgagctttcattttaatctttgagcatcttaacaacaaatatgtttcctgcatatctcttttgacaagtactttgaagttaaccattttccaattacgttagaattattctgggtagactttccctttgacaatgcacattcttataattaatttcttgcaggatacaaaaattacatagaaaagcaacattttaaaaagacaaaaggggtctcccacgttctttctgtgccctcaccccagtctcatttcaagagagtagtcgctattacccacaatgtcatgccttttcaaatgccagtaattatatgcttaagaagattaaagctttatttgctcagatcttaagtccatgggacttctattagtaactaatcaaaatgatcattactgttagaaggtgggaaatggtagaacattgcttttgaaaactatatttggcaccattaatacaaaggctgggatcgttgtgatgagtgctggtcatgctaaccatgttcccgcatggctggtgattatgtcctgggttgggttctgcacggtagcctgctttgggttagggacagtcacacctggtctgtcctgacttctttctgggccctcctaaccaaaccaggggaggggagaaggacccaattcttttcctttggtgcacgtagcctggacccgttatggacagaggccaaaggaagataacagtgtggtgtccagagatgaaaccaagtggttgatgggcagttctttgagcaaccttgtttatgagcctattgatatgcagatatagaggcatccaatactattgactaatttaaaatcttattcagtgagtcaacactctaaataagcaatggagatggttccattcatttttttgcaagtatcatttttataaacataaatttcctgagatttttgttttcatcttagcctctgtggagctgcttcgtggttatgataagtgctgtgtgatgctcaccttgggaggtctgcgacatatattgaagtcatctctaacctgaagtactgacagactttctggaagaaaaggcttgtaggaggaaacttcagaattctattaaatggtgtaaatgatgaaattatagttgatatatgctagagcatcagtgctgggtattttagaagggatggagtcatcattggctaatgttcccagtgaaggattgagggaggaacattgtgctgaaggatcaacagagtctggatgtgctctgagcaggagcacatgggctttgcaggccacgaaacagcaagagtaaggacaaggtgaacacgataggttgatgcagtgcattaatgctcatgagcggtttagagaagcagtcagagatgagaggatggcagctagctgaaagataaggacagacaatggaagaccttgagtggctggatgtagatcgagtgacattgcataggttgaacaggtgttttatacagttaatgaaatccatttttgttttgttaacttttagcattttttaaaagtatatattgtatataacattcttggtagaaaagttacaaaatgctcattagtaaatagaaaagatgtcaattactcatactaccaccatccagaaatatcactctgaacatgttggcacacatccttcctaacatttttctctacacataacacgtgtgtaagacttttttttgaacaaaaaatagaatcacaaacatgctgatttattttttcccctttattggtctttagctcccaaatgcctcctcacagatacccactgtgatgtgtttgatgtgtgtcctgaacacgcatgcttccttataaaaggtgtgtgtgtgtgtgtatgtgtgtctgtgtgtgtgttttaaagtttacataactcagccgggcacggtggctcacgcctgtaatgccagctgttgggaggccaaggcaggtggatcacttgaggtcaagagtttgagaccagcctggtcaacatggcgaaaccctgtctctactaacaatacaaaaaaaaaagaggcaggagaattgcatgaacctaggaggcggaggttgcagtgagccaagatcgcaccactgcactccagcctgggcaacacagcaaggctgtctcaaataatatttagtgattccataatttttcgggtggggccgctctggcccagtcgattctatgttggagcaggcttttcatgcgggccattttggggttacttggccattcggcctatttgggtctttttcaattcaccgg

SEQ ID NO: 323042 - DNA, 1268 bp, Homo sapiens
tcccatccccagggcctgccacagaataggcattcagtaaatattttttgaatgattgactgagaaatcacacctctgtttcttttaaacacatcctgatagctccataagtttcatcagggtcagtggtttccattgtcctgactgctggccacagtgacctgttctgtgctttatttgacaagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagaacgtgcacccacagccaccttccatgacagtaaacataacattgtgcatgtgcatttcgatgcaaccagaggatggttactgacttctggaactgacaaggttattaagttgtgggatatgaccccagtcgtgtcttgatgactctcccaggaatcagaaagatagtatttactaaagaaacggttgttttaacccaaatcattaccagagtggtaaagcagacatgtgagaagtaagaaagaaactaaagaccctgaatgaatttgcagattacccatgtgcacagtggggacctggccagtgagcactcgcaaggggactcttccaacttgttcatacaatataaaagaagctatttttttaacaaatggtttatacagtctggctgtgctgcattgttttgagtgtaccgaaaaatctgtgtggggtgtttaatttttatacttttcaacaccccattttacttgttgctttgtcagagaaataagggaggtatctactcagagtattttggtcattatactttctgtgtttacttcaacatgtgtcacgtggccagcggctttttcttctcttccctctgcacctacctgcaccttctctgcctttcctggaggggatgtatttatgttatttattcccagtgtttctgctttcatgtcctcctcagtggagagatttggaaactcatcatgtggattcaccagccagctgctggaattgcctgaagagcgatttgtttgtaatgtctgcctcattcacgttcttatgaagtagaaaagactgtgtttctgcctcagttgcctctgtctttcccacattaaaaaaaaaaatgctgtgagaaaaaag

SEQ ID NO: 323043 - DNA, 2629 bp, Homo sapiens
gccctgtggttctggccctgcctcccttcctgcttatttcttatttcttttatgattaaaccatgaaataaggcatgtaacgttaaagaattgtagcataaaaggagttgtttgggttgttttttttttccctcacaagttggcatgtaacattactgtgatggagagttcataagaattttgactgagactaagctgtttaaatctgttacaccattcacagcaaaagtacaggtgaggaaaagaaaccatctatttcctggtgattagtcctttggtataaaatgcactacaaaaacggaggactcacgtgatttatgtcatggaagtagaaataattattttgtactttataagtcatgttctaaatagttccccagatatcaatatatccttagttttctagcacgtatttacatgttatcagaacattcttttttatgagctttcattttaatctttgagcatcttaacaacaaatatgtttcctgcatatctcttttgacaagtactttgaagttaaccattttccaattacgttagaattattctgggtagactttccctttgacaatgcacattcttataattaatttcttgcaggatacaaaaattacatagaaaagcaacattttaaaaagacaaaaggggtctcccacgttctttctgtgccctcaccccagtctcatttcaagagagtagtcgctattacccacaatgtcatgccttttcaaatgccagtaattatatgcttaagaagattaaagctttatttgctcagatcttaagtccatgggacttctattagtaactaatcaaaatgatcattactgttagaaggtgggaaatggtagaacattgcttttgaaaactatatttggcaccattaatacaaaggctgggatcgttgtgatgagtgctggtcatgctaaccatgttcccgcatggctggtgattatgtcctgggttgggttctgcacggtagcctgctttgggttagggacagtcacacctggtctgtcctgacttctttctgggccctcctaaccaaaccaggggaggggagaaggacccaattcttttcctttggtgcacgtagcctggacccgttatggacagaggccttctttgagcaaccttgtttatgagcctattgatatgcagatatagaggcatccaatactattgactaatttaaaatcttattcagtgagtcaacactctaaataagcaatggagatggttccattcatttttttgcaagtatcatttttataaacataaatttcctgagatttttgttttcatcttagcctctgtggagctgcttcgtggttatgataagtgctgtgtgatgctcaccttgggaggtctgcgacatatattgaagtcatctctaacctgaagtactgacagactttctggaagaaaaggcttgtaggaggaaacttcagaattctattaaatggtgtaaatgatgaaattatagttgatatatgctagagcatcagtgctgggtattttagaagggatggagtcatcattggctaatgttcccagtgaaggattgagggaggaacattgtgctgaaggatcaacagagtctggatgtgctctgagcaggagcacatgggctttgcaggccacgaaacagcaagagtaaggacaaggtgaacacgataggttgatgcagtgcattaatgctcatgagcggtttagagaagcagtcagagatgagaggatggcagctagctgaaagataaggacagacaatggaagaccttgagtggctggatgtagatcgagtgacattgcataggttgaacaggtgttttatacagttaatgaaatccatttttgttttgttaacttttagcattttttaaaagtatatattgtatataacattcttggtagaaaagttacaaaatgctcattagtaaatagaaaagatgtcaattactcatactaccaccatccagaaatatcactctgaacatgttggcacacatccttcctaacatttttctctacacataacacgtgtgtaagacttttttttgaacaaaaaatagaatcacaaacatgctgatttattttttcccctttattggtctttagctcccaaatgcctcctcacagatacccactgtgatgtgtttgatgtgtgtcctgaacacgcatgcttccttataaaaggtgtgtgtgtgtgtgtatgtgtgtctgtgtgtgtgttttaaagtttacataactcagccgggcacggtggctcacgcctgtaatgccagctgttgggaggccaaggcaggtggatcacttgaggtcaagagtttgagaccagcctggtcaacatggcgaaaccctgtctctactaacaatacaaaaaaaaaagaggcaggagaattgcatgaacctaggaggcggaggttgcagtgagccaagatcgcaccactgcactccagcctgggcaacacagcaaggctgtctcaaataatatttagtgattccataatttttcgggtggggccgctctggcccagtcgattctatgttggagcaggcttttcatgcgggccattttggggttacttggccattcggcctatttgggtctttttcaattcaccgg

SEQ ID NO: 323044 - DNA, 2629 bp, Homo sapiens
gccctgtggttctggccctgcctcccttcctgcttatttcttatttcttttatgattaaaccatgaaataaggcatgtaacgttaaagaattgtagcataaaaggagttgtttgggttgttttttttttccctcacaagttggcatgtaacattactgtgatggagagttcataagaattttgactgagactaagctgtttaaatctgttacaccattcacagcaaaagtacaggtgaggaaaagaaaccatctatttcctggtgattagtcctttggtataaaatgcactacaaaaacggaggactcacgtgatttatgtcatggaagtagaaataattattttgtactttataagtcatgttctaaatagttccccagatatcaatatatccttagttttctagcacgtatttacatgttatcagaacattcttttttatgagctttcattttaatctttgagcatcttaacaacaaatatgtttcctgcatatctcttttgacaagtactttgaagttaaccattttccaattacgttagaattattctgggtagactttccctttgacaatgcacattcttataattaatttcttgcaggatacaaaaattacatagaaaagcaacattttaaaaagacaaaaggggtctcccacgttctttctgtgccctcaccccagtctcatttcaagagagtagtcgctattacccacaatgtcatgccttttcaaatgccagtaattatatgcttaagaagattaaagctttatttgctcagatcttaagtccatgggacttctattagtaactaatcaaaatgatcattactgttagaaggtgggaaatggtagaacattgcttttgggtcatgctaaccatgttcccgcatggctggtgattatgtcctgggttgggttctgcacggtagcctgctttgggttagggacagtcacacctggtctgtcctgacttctttctgggccctcctaaccaaaccaggggaggggagaaggacccaattcttttcctttggtgcacgtagcctggacccgttatggacagaggccaaaggaagataacagtgtggtgtccagagatgaaaccaagtggttgatgggcagttctttgagcaaccttgtttatgagcctattgatatgcagatatagaggcatccaatactattgactaatttaaaatcttattcagtgagtcaacactctaaataagcaatggagatggttccattcatttttttgcaagtatcatttttataaacataaatttcctgagatttttgttttcatcttagcctctgtggagctgcttcgtggttatgataagtgctgtgtgatgctcaccttgggaggtctgcgacatatattgaagtcatctctaacctgaagtactgacagactttctggaagaaaaggcttgtaggaggaaacttcagaattctattaaatggtgtaaatgatgaaattatagttgatatatgctagagcatcagtgctgggtattttagaagggatggagtcatcattggctaatgttcccagtgaaggattgagggaggaacattgtgctgaaggatcaacagagtctggatgtgctctgagcaggagcacatgggctttgcaggccacgaaacagcaagagtaaggacaaggtgaacacgataggttgatgcagtgcattaatgctcatgagcggtttagagaagcagtcagagatgagaggatggcagctagctgaaagataaggacagacaatggaagaccttgagtggctggatgtagatcgagtgacattgcataggttgaacaggtgttttatacagttaatgaaatccatttttgttttgttaacttttagcattttttaaaagtatatattgtatataacattcttggtagaaaagttacaaaatgctcattagtaaatagaaaagatgtcaattactcatactaccaccatccagaaatatcactctgaacatgttggcacacatccttcctaacatttttctctacacataacacgtgtgtaagacttttttttgaacaaaaaatagaatcacaaacatgctgatttattttttcccctttattggtctttagctcccaaatgcctcctcacagatacccactgtgatgtgtttgatgtgtgtcctgaacacgcatgcttccttataaaaggtgtgtgtgtgtgtgtatgtgtgtctgtgtgtgtgttttaaagtttacataactcagccgggcacggtggctcacgcctgtaatgccagctgttgggaggccaaggcaggtggatcacttgaggtcaagagtttgagaccagcctggtcaacatggcgaaaccctgtctctactaacaatacaaaaaaaaaagaggcaggagaattgcatgaacctaggaggcggaggttgcagtgagccaagatcgcaccactgcactccagcctgggcaacacagcaaggctgtctcaaataatatttagtgattccataatttttcgggtggggccgctctggcccagtcgattctatgttggagcaggcttttcatgcgggccattttggggttacttggccattcggcctatttgggtctttttcaattcaccgg

SEQ ID NO: 323045 - DNA, 1194 bp, Homo sapiens
attagactattttactggcaagtccttctgagctcaaacttagcaaaagccctgtggttttaaaagctcgggtggagattatcacagacaccattggagcaacattctccagaaggacttttagaaattttcatctctttcccattttaaagactataagatttcttgtattttttttttatcataactggtcaccagggaataaaggcagatctgaggagcattcctgtcagtgaagcagttttagccacgaggccaaaatttagagcctaatgtcatcctagatctctctcattcatatgtcaccaccttttcccctcagaagctttctttgctccttctagacgtgcacccacagccaccttccatgacagtaaacataacattgtgcatgtgcatttcgatgcaaccagaggatggttactgacttctggaactgacaaggttattaagttgtgggatatgaccccagtcgtgtcttgatgactctcccaggaatcagaaagatagtatttactaaagaaacggttgttttaacccaaatcattaccagagtggtaaagcagacatgtgagaagtaagaaagaaactaaagaccctgaatgaatttgcagattacccatgtgcacagtggggacctggccagtgagcactcgcaaggggactcttccaacttgttcatacaatataaaagaagctatttttttaacaaatggtttatacagtctggctgtgctgcattgttttgagtgtaccgaaaaatctgtgtggggtgtttaatttttatacttttcaacaccccattttacttgttgctttgtcagagaaataagggaggtatctactcagagtattttggtcattatactttctgtgtttacttcaacatgtgtcacgtggccagcggctttttcttctcttccctctgcacctacctgcaccttctctgcctttcctggaggggatgtatttatgttatttattcccagtgtttctgctttcatgtcctcctcagtggagagatttggaaactcatcatgtggattcaccagccagctgctggaattgcctgaagagcgatttgtttgtaatgtctgcctcattcacgttcttatgaagtagaaaagactgtgtttctgcctcagttgcctctgtctttcccacattaaaaaaaaaaatgctgtgagaaaaaag

SEQ ID NO: 323046 - DNA, 453 bp, Homo sapiens
gatttattttttcccctttattggtctttagctcccaaatgcctcctcacagatacccactgtgatgtgtttgatgtgtgtcctgaacacgcatgcttccttataaaaggtgtgtgtgtgtgtgtatgtgtgtctgtgtgtgtgttttaaagtttacataactcagccgggcacggtggctcacgcctgtaatgccagctgttgggaggccaaggcaggtggatcacttgaggtcaagagtttgagaccagcctggtcaacatggcgaaaccctgtctctactaacaatacaaaaaaaaaaaaattagccaggcatggttgcagacgcctgtaatctcagcttctcaggaggctgaggcaggagaattgcatgaacctaggaggcggaggttgcagtgagccaagatcgcaccactgcactccagcctgggcaacacagcaaggctgtctcaa

SEQ ID NO: 323047 - DNA, 1622 bp, Homo sapiens
ttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagaacgtgcacccacagccaccttccatgacagtaaacataacattgtgcatgtgcatttcgatgcaaccagaggatggttactgacttctggaactgacaaggttattaagttgtgggatatgaccccagtcgtgtcttgatgactctcccaggaatcagaaagatagtatttactaaagaaacggttgttttaacccaaatcattaccagagtggtaaagcagacatgtgagaagtaagaaagaaactaaagaccctgaatgaatttgcagattacccatgtgcacagtggggacctggccagtgagcactcgcaaggggactcttccaacttgttcatacaatataaaagaagctatttttttaaca

SEQ ID NO: 323048 - DNA, 1779 bp, Homo sapiens
ttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagagtaagttcctgcagcctgcagaccgcttcaggttaaggcgagaatttaatctgagccttgcactcagcgccgcaaccatcactcaggttgctctagtttctgctggtttagaatatagtccacggcaagcagtaaaagctctcctttgccaccaagagatttgtggtatcctgtgagatgagagaagagaaaatacactcaaagaattcatctctgtgttctttctaatttctaggttatgtgcctttaaattagctgctcccagaacaaacccttctgtctgctcatttacttgagaattacccaggagtataagggctcaggattcactttctgtcccaagctggtatctttacaggagttgagtgagtccatgggtccagaaggtttcattttccgggaagagctaagtcgctttacccaagaggcaaatattcccagttgcccagttactcagctggctgcttgtcagacctgcccagtaacccaggacataggttacttaccccttggtgtgctgtgga

SEQ ID NO: 323049 - DNA, 1415 bp, Homo sapiens
ttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagaacgtgcacccacagccaccttccatgacagtaaacataacattgtgcatgtgcatttcgatgcaaccagaggatggttactgacttctggaactgacaaggttattaaggtgctgtcgttttgcaaaaggaaatctttatatgaaatgggtaccgagctc

SEQ ID NO: 323050 - DNA, 3902 bp, Homo sapiens
  misc_feature (1)..(1): n is a, c, g, or t
naagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggagctgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccacc

SEQ ID NO: 323051 - DNA, 935 bp, Homo sapiens
tgcttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatccttgtgaatctggggtcttctgccgagtgggtggttgataagtgttggttgagttgacttgagcctctcctacaagatgactcataagcccagtgtgggtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccacc

SEQ ID NO: 323052 - DNA, 369 bp, Homo sapiens
  misc_feature (344)..(344): n is a, c, g, or t
tgcttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatccttgtgaatctggggtcttctgccgagtgggtggttgataagtgttggttgagttgacttgagcctctcctacaagcattggaaccttccaatttaacacggccccccccaaagggctggggctgggggcgctttttccacgaagactccatccactctctggggaatgacacggactccctctcctngcgaacaagcttgggggcccaaagc

SEQ ID NO: 323053 - DNA, 4101 bp, Homo sapiens
  misc_feature (1)..(1): n is a, c, g, or t
naagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggagctgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttca

SEQ ID NO: 323054 - DNA, 3779 bp, Homo sapiens
  misc_feature (1)..(1): n is a, c, g, or t
naagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggagctgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccacc

SEQ ID NO: 323055 - DNA, 1931 bp, Homo sapiens
gatccccatcggcacccaaggagcagagaaatcaaattcagttatggtgaacagtttttttcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggagctgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttca

SEQ ID NO: 323056 - DNA, 4159 bp, Homo sapiens
  misc_feature (1)..(1): n is a, c, g, or t
naagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggagctgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttcaaacacacaccttataacataaaaaaacctcgggccccaaagcgcggcggcgaacaacg

SEQ ID NO: 323057 - DNA, 4085 bp, Homo sapiens
  misc_feature (1)..(1): n is a, c, g, or t
naagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggagctgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtaggcaccggagttgaggctgtgcgccttggtgggcttcacgtcttcccctggatttgcttagtactcagccagtgccacagtttgaagattctcattaaatgattcatttcatttca

SEQ ID NO: 323058 - DNA, 1184 bp, Homo sapiens
tgcttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatccttgtgaatctggggtcttctgccgatttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttca

SEQ ID NO: 323059 - DNA, 641 bp, Homo sapiens
gacgtttactggaaagtgtacaggaaacaggatagaggaaatatagctggaccgggtgaatacgtatgatctcatcgttgtttattaggtaaatatttactgaccaaactatgtttttgaaagcactttgagaataacagtctcgctttcacctctgtcggggtcttacttcagaaacctcctttggacttaaaattctccttttttttcttccttttcctagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttca

SEQ ID NO: 323060 - DNA, 624 bp, Homo sapiens
acacatagtaggcatttgatgaatatttcttgaatgaatgaatacagtatgatctcatcgttgtttattaggtaaatatttactgaccaaactatgtttttgaaagcactttgagaataacagtctcgctttcacctctgtcggggtcttacttcagaaacctcctttggacttaaaattctccttttttttcttccttttcctagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttca

SEQ ID NO: 323061 - DNA, 1406 bp, Homo sapiens
  misc_feature (1)..(1): n is a, c, g, or t
naagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattggtcagaattcagcccctgtgtgtattgaacagcttccatgtgccaggcaccatttggatgttttatctaaaaattat

SEQ ID NO: 323062 - DNA, 468 bp, Homo sapiens
  misc_feature (1)..(1): n is a, c, g, or t
naagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagc

SEQ ID NO: 323063 - DNA, 142 bp, Homo sapiens
tcctactttaaatatccaggattgttacagagtgtttaaacaagtggaatagtgcttctgcaaatgtatgagcaggaaattattagggaacacttaaaaacatttttttctcctcctttcttgatgttatttctgcttccag

SEQ ID NO: 323064 - DNA, 372 bp, Homo sapiens
aacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcatt

SEQ ID NO: 323065 - DNA, 469 bp, Homo sapiens
gggcaggcccaggcctctaccctccctgcgccattgccctccctggcccacagaagtgagcctgagggatacctggacagccaggtggccgtgcacagctgtagggtgttctctgaaccggcatagcatgctgtagcctctgcatcactgtcaggtggtggcttagcggggcctcaaagaggtgttgttgatgcgttatttggccctggggtttgtgatgggtcaggtgggccctttgtacctccctctggtctggatgcttcagacctcgtgttgtctacatgtccgagccctttggggtggggttcatcctccctgcacttggctttcacacagctctcctggatatccatggccctaatcattgcattctttgctctctcctcagtggtcgtaacccacaaaatccttcggaaggccagaggaaacctggaggtatgccctttgagtcttttcactgcaggccagt

SEQ ID NO: 323066 - DNA, 862 bp, Homo sapiens
tgcttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatccttgtgaatctggggtcttctgccgatttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccacc

SEQ ID NO: 323067 - DNA, 3366 bp, Homo sapiens
ccaggcagagggcacggcccatgcaaaagcatggaggcatgacacagcacgcaatgtgcagggaatcatggttaattttgtaggaaatctccagagtggtgccagagatattcctggaaaggttgcctggaactagatcatggaaggtctcatgtagatactgggaatgtcgatgaattttagggggtgtgtgtgtgggtttatcatggttaaaattactttttagaacagtcactctgaggaagaggacaactgaggggtaaagagggaaagactagggctttttgagggaggcttgttaggaaagactggaggctttttgagggaagtgtgttaggaaatactagggcctttttgagggaggcttgttaggtcactgcagtggtcttggcttggctagggctgtgaggaaggagagagggtttggattttagtaaaagagatactgacataagtgtatttgattttcagactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggagctgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttca

SEQ ID NO: 323068 - DNA, 3864 bp, Homo sapiens
  misc_feature (1)..(1): n is a, c, g, or t
naagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggagctgaagttgaggcagcagctgctctcacagaatgacaagctattgcagtctctccgagtggagctgaaggcgtatgagaagctggatgaagagcacaggagactgagagatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttca

SEQ ID NO: 323069 - DNA, 4253 bp, Homo sapiens
  misc_feature (1)..(1): n is a, c, g, or t
naagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggagctgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttcaaaaaaaaaaaaacaaaggggggggcaaaaataccgaaggggcccagtaggttcccgttttgtaaaggggccataagggcgaaataacaaggcggggccgttaaaccggcggaaaaggcgggcttggcggccccctggggggcatgcccccca

SEQ ID NO: 323070 - DNA, 1257 bp, Homo sapiens
tgcttctcagaagccttccctgttctctccctccctgcacagataattgttttttctggctctggcccttcatcactctgctgttgcaccttctgcagtgtctgtgttctgatcagactgtgggctactggaatgcaggcaccagcttgagtcatccttgtgaatctggggtcttctgccgagtgggtggttgataagtgttggttgagttgacttgagcctctcctacaagatgactcataagcccagtgtgggtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttca

SEQ ID NO: 323071 - DNA, 3032 bp, Homo sapiens
  misc_feature (1)..(1): n is a, c, g, or t
naagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggagctgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccagcggtcatcctggggccttagctgaaaaacgatgggcaattccccggagggtatc

SEQ ID NO: 323072 - DNA, 674 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323073 - DNA, 652 bp, Homo sapiens
tagctagtgagctgggggttatcggcacgaggccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323074 - DNA, 630 bp, Homo sapiens
  misc_feature (21)..(21): n is a, c, g, or t
acgataggctagtcgaggccnggggttcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323075 - DNA, 670 bp, Homo sapiens
  misc_feature (25)..(26): n is a, c, g, or t
ggtggagctcaaggatccttaattnnttaatcccccccccccccccccgcccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323076 - DNA, 645 bp, Homo sapiens
  misc_feature (18)..(19): n is a, c, g, or t
cggacgcgtgggtcgacnnacgcgtccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323077 - DNA, 653 bp, Homo sapiens
taaaaaaaaaaacttacggctaggtacgaggctccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323078 - DNA, 615 bp, Homo sapiens
ggacgcgtgggtcgacccacgcgtcggacccacgcgtcgcggacgcgtgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323079 - DNA, 845 bp, Homo sapiens
  misc_feature (677)..(677): n is a, c, g, or t
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgggncaaacaaacggaaaaaaaaaagtgtgggccgactcgcgccggaaaacgttattaaacaatcgtgggggccggccccaggttgtgactggccaagggggcgagaacgggcgaaggggggttaccaaagagccggggacgggtgaaacaaggtggccggtaacggcggat

SEQ ID NO: 323080 - DNA, 738 bp, Homo sapiens
  misc_feature (716)..(716): n is a, c, g, or t
  misc_feature (734)..(734): n is a, c, g, or t
taaaaaaaaaaacttacggctaggtacgaggctccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaacacaaaaacaaaaaaaaaaaaaaaaaaaaaaaaaaaaaaccggggcgtttttttngggggggggaaaaagggnttta

SEQ ID NO: 323081 - DNA, 941 bp, Homo sapiens
tagctagtgagctgggggttatcggcacgaggccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaacacacacaatcgtcatgggctactcttcaatcagcacatatgcctcgtagtaacagcattctcatcaaaaccccctggaagttcaccggggccagtcaattctcatactcgcccaggggcttacatcctcattactattcgggcttagaaagtccagaatacagaacgcactcccaaggccggataataatctctctcaaggcgtcaaactgtattcccttaatagtcttggggactttaggaggcctcgtacttcgcttaaccccatttaactcagcgggcgcg

SEQ ID NO: 323082 - DNA, 883 bp, Homo sapiens
  misc_feature (671)..(671): n is a, c, g, or t
  misc_feature (675)..(675): n is a, c, g, or t
  misc_feature (689)..(689): n is a, c, g, or t
  misc_feature (705)..(705): n is a, c, g, or t
  misc_feature (707)..(707): n is a, c, g, or t
  misc_feature (716)..(716): n is a, c, g, or t
  misc_feature (728)..(729): n is a, c, g, or t
  misc_feature (732)..(732): n is a, c, g, or t
  misc_feature (736)..(736): n is a, c, g, or t
  misc_feature (741)..(741): n is a, c, g, or t
  misc_feature (743)..(743): n is a, c, g, or t
  misc_feature (746)..(746): n is a, c, g, or t
  misc_feature (752)..(752): n is a, c, g, or t
  misc_feature (754)..(755): n is a, c, g, or t
  misc_feature (759)..(759): n is a, c, g, or t
  misc_feature (762)..(762): n is a, c, g, or t
  misc_feature (764)..(766): n is a, c, g, or t
  misc_feature (776)..(776): n is a, c, g, or t
  misc_feature (778)..(778): n is a, c, g, or t
  misc_feature (785)..(785): n is a, c, g, or t
  misc_feature (795)..(796): n is a, c, g, or t
  misc_feature (804)..(804): n is a, c, g, or t
  misc_feature (806)..(806): n is a, c, g, or t
  misc_feature (813)..(813): n is a, c, g, or t
  misc_feature (820)..(820): n is a, c, g, or t
ggacgcgtgggtcgacccacgcgtcggacccacgcgtcgcggacgcgtgccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgancccnccccaccccccccncccccccccccccccncnccccccccncccacccccccnnccncccnccccncnccncccccnannaccnccncnnncccccccccncnccccccncccccacacnnccccaccncncacaccnccccccnccccccccccccctccccgccacccaccccccccccctccccccccaccccccacccccctct

SEQ ID NO: 323083 - DNA, 913 bp, Homo sapiens
taaaaaaaaaaacttacggctaggtacgaggctcggtgtgtaattcggccgaggctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgcggtgctcgccgcatgttttctttgcacactgcagagctcaaaggggtgctatgagaggccggcccagtcagctcctggggtgcagctgagctgccatttctttgtcctgggaggggtcttcagtgcaaacaaacaaaccctcacatcctcctgtcctggagtgggccctccaggcgcccccacccctgagctccctcttgcttggtcagttctcagccctgctggcagccctgggctatgagctgcaggggtactgtctgtcctgggccctaaatctgtcccaactgccttgtgagacacaggcctcccaggctcccctgctgagtctggaccagggagaatctccctagatagtggggttggcgttcactccctggggattctcctaagtctctggttcccaaagttttcagagtagacacaagtgggcacccgaggggcgctctctgctgcttgggg

SEQ ID NO: 323084 - DNA, 453 bp, Homo sapiens
gcggccgcctactactactactgctcgaattcaagcttctaacgatgtacggggatgtaccgggaataccgggacctgaccaccgcaggcgctgtcacccagtgctaccgagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctggggcactcgcgccgatgccaccggcctgtgggtctctgaagggacccccccccaatcggactgccaaattctccggtttgccccgggatattatagaaaattatttgtatgaata

SEQ ID NO: 323085 - DNA, 191 bp, Homo sapiens
gcggccgcctactactactactgctcgaattcaagcttctaacgatgtacggggatgtaccgggaataccgggacctgaccaccgcaggcgctgtcacccagtgctaccgagacatgccccctgccctcgcctggaatcagtgttactgcatctgattaaatgtctccagaaataaagaataattctgcca

SEQ ID NO: 323086 - DNA, 349 bp, Homo sapiens
gcatcctgctgtgactctagagtatcccctgtccggttcgggaaataccgcgactgatcacacgttaccgggcgtcacccagcagtcatgatagctgtgtgccgtgagtcgctcccgaggtcattacttgcaaatcctcgtaagcgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323087 - DNA, 678 bp, Homo sapiens
  misc_feature (12)..(12): n is a, c, g, or t
  misc_feature (16)..(16): n is a, c, g, or t
tcggcacgagcncgtncgaattcgtgcacgacctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgtctcagagcctgtggtgggggtggtgtggtgttggtgtgggttggggggtgggggggggtgtggtggtta

SEQ ID NO: 323088 - DNA, 930 bp, Homo sapiens
gcatgaggcacgtacaggcagaggattaattaggttttcagtttcagtttcccagaaaggaggtgggctttttttttcaccctgctttaaaagcccttgggcccttcccagctgggtgccagccaactgtggctgcctgggacactccatcttaagtccctgtgcctctgctgtgtgttactgagtgcctaggccgtgccagcctgtattcatctgtactatgacctgaagaggcagaggccatcactgttggtccggtctccacctggggaaactgaggtgtctctgtggtgacgagcagggcttcatccagtgcctctgtccccaccgaggggactatgggagacatggagggtgtgtgagcaacaggtgagactggagccagctgaaaactgggagaccgacccagccaacaaacaatgtcggtctctgtcttggcacctgcaggaaacaagctcctacttccagaaaaagtgctcctgggactccaggataccagagacgcggtggtacatgcctgtaatcccaacacttaggcaggaggatcactcgagcccagaagatcaagactagtgtgagcaacaaaatccttccctggcaccggttccaggaggacctcgttcttaggcagcatctgtgtctctgtttgtaagacacacagagtatccttaacccactgcagatatttccctgggtccacggtcaatcaacaccacctttcagtctccagcctcttaaccagcccagggctgagtgttgtttatagtattaatatgtttctggctgggctcagtggctcatgcctgtaatcccggcactatgggaggctgaggcaggcggatcacttgaggtcaggagttcaagaccagcctggccaacatagtaaaaccccgtctctactaaaaatacaaaatgagccgggtgtggtgg

SEQ ID NO: 323089 - DNA, 1003 bp, Homo sapiens
ttccggcggaagttgctgggcgcggaaagccggcaagacctttttttccgccatcatcgctcacgcgcgcaaccctggcgacgcgtggtggcgaggctccgcctccccacgccattggccagcagctcctcgggcacgcgtatactgcgcttccgggcaatctccgccccccccccccgcatggccttctgggagttgtagttcggtcgcgagcgctgccgtcgggaggcgctccgaggttcgaggctgtgccccgcgaccccgccttcggcgctcggctcgcaggatggatcccgtacccgggacagactcggcgccgctggctggcctggcctggtcgtcggcctctgcacccccgccgcgggggttcagcgcgatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccagctttgcacacgccgcttcctctgcctggggcactttttctctcctttttgtagctcattctccgtcctccgtcagatgtcaccttcacccttccctacccctcctcttctgggcccacaaccctagtgcagccctgggcgacagagtgagactctgtctcaaaaagaaaagaaaagaaaacagaccttgagccagatttggctcatgggtgctagttgtccaacctctataggattagagggctcacggaaagtaagttttgagggccacgatgggcacccagctctgtccgattccacagctagccaccccatgaatgcagcttcatatcaccaaagatcagcctactccagcggttcctaaaggctgcatggaatcccctccttcatctataccattcatgatttaaccactcctcccaccccatccc

SEQ ID NO: 323090 - DNA, 1270 bp, Homo sapiens
  misc_feature (1057)..(1057): n is a, c, g, or t
  misc_feature (1080)..(1080): n is a, c, g, or t
  misc_feature (1083)..(1083): n is a, c, g, or t
  misc_feature (1089)..(1089): n is a, c, g, or t
  misc_feature (1091)..(1091): n is a, c, g, or t
  misc_feature (1097)..(1097): n is a, c, g, or t
  misc_feature (1106)..(1106): n is a, c, g, or t
  misc_feature (1110)..(1111): n is a, c, g, or t
ttccggcggaagttgctgggcgcggaaagccggcaagacctttttttccgccatcatcgctcacgcgcgcaaccctggcgacgcgtggtggcgaggctccgcctccccacgccattggccagcagctcctcgggcacgcgtatactgcgcttccgggcaatctccgccccccccccccgcatggccttctgggagttgtagttcggtcgcgagcgctgccgtcgggaggcgctccgaggttcgaggctgtgccccgcgaccccgccttcggcgctcggctcgcaggatggatcccgtacccgggacagactcggcgccgctggctggcctggcctggtcgtcggcctctgcacccccgccgcgggggttcagcgcgatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggntcgggtggagaaaccgggtgccngcngccccnangttatntcctcaccntcgnnaaaaggcctaacacaccgaatgggcacaccccacagatactgggactcacgagtgtttaccaggggaatagaggcgagaaagagaatacccaccgggtggacaaaatgtaaaggagggggtaacaaaacaagtggaagcttaacgcaacatcaagttac

SEQ ID NO: 323091 - DNA, 1415 bp, Homo sapiens
ttccggcggaagttgctgggcgcggaaagccggcaagacctttttttccgccatcatcgctcacgcgcgcaaccctggcgacgcgtggtggcgaggctccgcctccccacgccattggccagcagctcctcgggcacgcgtatactgcgcttccgggcaatctccgccccccccccccgcatggccttctgggagttgtagttcggtcgcgagcgctgccgtcgggaggcgctccgaggttcgaggctgtgccccgcgaccccgccttcggcgctcggctcgcaggatggatcccgtacccgggacagactcggcgccgctggctggcctggcctggtcgtcggcctctgcacccccgccgcgggggttcagcgcgatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggcttcgtggtggagaagaccgcggctgcccgcctgccccccagcgtctcatagtccctcacccttccgcggaaagagcccccttactccacctccccgccagcctggggccacccactgcatcctgggaaccttcgccctgcaaggcgtttgctatcttcagccactgggcggagctgcagccctggaggagggggcgggtcgaggctgcgtggtgatggggtctccgcccccacgccctgccgggcagggctggagctggacagaagccagtgcctttaagtcatttgtgtcaaaaccctctggggtccggaggctgtgcgggtgtcctcctggcaataaacactacccggttctcgcc

SEQ ID NO: 323092 - DNA, 1014 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaaaaaaaaaaaaacaaaaaaaaaaaaaaaaaaaaaaaacaaaaaaaaaaaacaaacaaaggggggccacggaactaagaaatacaccgcagggggggcgaacagataggacgcgagcacaccaggttgtaggagacaaaacgagaggggcccccaagtgacaggggagccgagcacatacagaaaggaacaggcagcgggagcgcatgaagctgcaaaccaaccgacgtcaggggcgggagcaccccagggccagcgggacacaccgaggggcagcgcaccccaacacaagggggggggggagaacacatggggggcgccacatccacaa

SEQ ID NO: 323093 - DNA, 1106 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaaaaaaaaaaaaacaaaaaaaaaaaaaaaaaaaaaaaacaaaaaaaaaaaaaaaaaaaacaagaggggagcggcgccacaggtgaaacgtcggcggaggagagggggatctgtggccgcgcggacgtggcgggcggggcacaaggaggtggagggagagtaaagggggcggaggggtggcgtgacatggggggacacggcggacgatgcaaggagggcgcgccggggcatgagggaggcggaggagaaaaggagacggtcggacgcagccacggacgaaggcagccaaatcgacagcgaggcacaacgaccaacagagggcgataccacgaggcaggagcgggacatcgggagggacacaagcgggccgtccacagccgcgccggaaaacacggcacctggacagagaagagcacacgcgtg

SEQ ID NO: 323094 - DNA, 949 bp, Homo sapiens
  misc_feature (798)..(798): n is a, c, g, or t
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaaaaaaaaaaaaacccccgggggcctctctatattcggggggcgcggagaaaaagaggggtatctaaaagggcgccctgggcgccaaagggtgtgttcctcgtgaacccccganttttttcttgtgtcaccaaggtcggtgaaacacggggccggggcacccccataagagggaggcggcgtattaacatcgcggaaaacgccgcgggttaaccccggctttaatgaagcttcccgcaaaaccttccaccaccgtgcagccccgc

SEQ ID NO: 323095 - DNA, 718 bp, Homo sapiens
aacaacttatatagtgtgtaaggaactcaagagaaaccagtgagcgagcctttatgtgaaccactgaaacaatctcttaaaaataaggcaattcttttctaagtcaaattcatctcgtgccgaatcggcacgaggtgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323096 - DNA, 842 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaacaaaaaaaaaaaaaaacaaaaaaaaaaaaaaaaaaaaaaaaaacaaaaaaaaagggggggggggccaaaaaacaaataccccagggggggccaccaaaagagaaacacacaccattatattggagaaaaagaggggcgccacaaagggagcggcaaaaaaga

SEQ ID NO: 323097 - DNA, 759 bp, Homo sapiens
  misc_feature (737)..(737): n is a, c, g, or t
  misc_feature (755)..(755): n is a, c, g, or t
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaacacaaaaacaaaaaaaaaaaaaaaaaaaaaaaaaaaaaaccggggcgtttttttngggggggggaaaaagggnttta

SEQ ID NO: 323098 - DNA, 857 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaacacaaacaaagagacaacaaaaaaaaaaaacagaacaaaaagaaaaagagagggagaaaaagaacaaagaggaccagaagcagaccagaagtagcagaagacacaagggaggaaagagaacgagggggagaaaagagagggaaacagagaggactagggagagaaagtggacgaa

SEQ ID NO: 323099 - DNA, 963 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaacacacacaatcgtcatgggctactcttcaatcagcacatatgcctcgtagtaacagcattctcatcaaaaccccctggaagttcaccggggccagtcaattctcatactcgcccaggggcttacatcctcattactattcgggcttagaaagtccagaatacagaacgcactcccaaggccggataataatctctctcaaggcgtcaaactgtattcccttaatagtcttggggactttaggaggcctcgtacttcgcttaaccccatttaactcagcgggcgcg

SEQ ID NO: 323100 - DNA, 870 bp, Homo sapiens
  misc_feature (714)..(714): n is a, c, g, or t
  misc_feature (718)..(718): n is a, c, g, or t
  misc_feature (722)..(722): n is a, c, g, or t
  misc_feature (724)..(725): n is a, c, g, or t
  misc_feature (735)..(735): n is a, c, g, or t
  misc_feature (741)..(741): n is a, c, g, or t
  misc_feature (750)..(750): n is a, c, g, or t
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgcaaaaaacagaacacaaaccaaaacaaaaactgtggggcncctncccngnnaaaagtttanaaccancgtggggcngggccccacagggaaagacagaggacaaggggccacaagaacaggggcggcaggggggtgtccacaataaaagcggggacagaggtctgacaacagagaggccgggcaagggctcaaggc

SEQ ID NO: 323101 - DNA, 748 bp, Homo sapiens
  misc_feature (726)..(726): n is a, c, g, or t
  misc_feature (744)..(744): n is a, c, g, or t
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaacaaaaacaagaacaaaaacaaaaaaccggggcgtttttttngggggggggaaaaagggnttta

SEQ ID NO: 323102 - DNA, 873 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgtaacaaaaaaaaaaacaaaaaaaataaaaaaaaaaaaaaaaaaaaaaaaaaaaaacaaaaaaaaaaaaaaaaaaaaaaaacaaaaaaaaagggggggggggccaaaaaacaaataccccagggggggccaccaaaagagaaacacacaccattatattggagaaaaagaggggcgccacaaagggagcggcaaaaaaga

SEQ ID NO: 323103 - DNA, 737 bp, Homo sapiens
  misc_feature (715)..(715): n is a, c, g, or t
  misc_feature (733)..(733): n is a, c, g, or t
tagctagtgagctgggggttatcggcacgaggccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaacacaaaaacaaaaaaaaaaaaaaaaaaaaaaaaaaaaaaccggggcgtttttttngggggggggaaaaagggnttta

SEQ ID NO: 323104 - DNA, 743 bp, Homo sapiens
  misc_feature (721)..(721): n is a, c, g, or t
  misc_feature (739)..(739): n is a, c, g, or t
ggacgcgtgggtcgacccacgcgtcggacccacgcgtcgcggacgcgtgccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaacaaaaacaagaacaaaaacaaaaaaccggggcgtttttttngggggggggaaaaagggnttta

SEQ ID NO: 323105 - DNA, 848 bp, Homo sapiens
  misc_feature (692)..(692): n is a, c, g, or t
  misc_feature (696)..(696): n is a, c, g, or t
  misc_feature (700)..(700): n is a, c, g, or t
  misc_feature (702)..(703): n is a, c, g, or t
  misc_feature (713)..(713): n is a, c, g, or t
  misc_feature (719)..(719): n is a, c, g, or t
  misc_feature (728)..(728): n is a, c, g, or t
tagctagtgagctgggggttatcggcacgaggccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgcaaaaaacagaacacaaaccaaaacaaaaactgtggggcncctncccngnnaaaagtttanaaccancgtggggcngggccccacagggaaagacagaggacaaggggccacaagaacaggggcggcaggggggtgtccacaataaaagcggggacagaggtctgacaacagagaggccgggcaagggctcaaggc

SEQ ID NO: 323106 - DNA, 866 bp, Homo sapiens
  misc_feature (654)..(654): n is a, c, g, or t
  misc_feature (658)..(658): n is a, c, g, or t
  misc_feature (672)..(672): n is a, c, g, or t
  misc_feature (688)..(688): n is a, c, g, or t
  misc_feature (690)..(690): n is a, c, g, or t
  misc_feature (699)..(699): n is a, c, g, or t
  misc_feature (711)..(712): n is a, c, g, or t
  misc_feature (715)..(715): n is a, c, g, or t
  misc_feature (719)..(719): n is a, c, g, or t
  misc_feature (724)..(724): n is a, c, g, or t
  misc_feature (726)..(726): n is a, c, g, or t
  misc_feature (729)..(729): n is a, c, g, or t
  misc_feature (735)..(735): n is a, c, g, or t
  misc_feature (737)..(738): n is a, c, g, or t
  misc_feature (742)..(742): n is a, c, g, or t
  misc_feature (745)..(745): n is a, c, g, or t
  misc_feature (747)..(749): n is a, c, g, or t
  misc_feature (759)..(759): n is a, c, g, or t
  misc_feature (761)..(761): n is a, c, g, or t
  misc_feature (768)..(768): n is a, c, g, or t
  misc_feature (778)..(779): n is a, c, g, or t
  misc_feature (787)..(787): n is a, c, g, or t
  misc_feature (789)..(789): n is a, c, g, or t
  misc_feature (796)..(796): n is a, c, g, or t
  misc_feature (803)..(803): n is a, c, g, or t
tagctagtgagctgggggttatcggcacgaggccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgancccnccccaccccccccncccccccccccccccncnccccccccncccacccccccnnccncccnccccncnccncccccnannaccnccncnnncccccccccncnccccccncccccacacnnccccaccncncacaccnccccccnccccccccccccctccccgccacccaccccccccccctccccccccaccccccacccccctct

SEQ ID NO: 323107 - DNA, 758 bp, Homo sapiens
  misc_feature (661)..(661): n is a, c, g, or t
  misc_feature (664)..(664): n is a, c, g, or t
tagctagtgagctgggggttatcggcacgaggccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgcccaaaaanaanagcattcgactactgggcattcccctataggagcgatacattactgccgcgttacacgcgactggaacctggctacactaatgctggtcccttc

SEQ ID NO: 323108 - DNA, 653 bp, Homo sapiens
  misc_feature (122)..(122): n is a, c, g, or t
  misc_feature (139)..(139): n is a, c, g, or t
atcctgattaaatgtctgaaaaaagaaccaagaaaaggcgtttttgttttcaacaaactttactaaataaccgaacgcggagagcacgccatgaaggcctcgggcacgtgggaaggagtggngtcctcccacccaaatncatcgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323109 - DNA, 631 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagacgaattccggcacgaccacgacgaactccg

SEQ ID NO: 323110 - DNA, 540 bp, Homo sapiens
atcctgattaaatgtctgaaaaaagaaccaagaaaaggcgtttttgttttcaacaaactttactaaataaccgaacgcggagagcacgccatgaaggcctcgggcacgaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323111 - DNA, 603 bp, Homo sapiens
  misc_feature (560)..(560): n is a, c, g, or t
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccactgactccaatgatcacagttccccgctgcccncaccggtgtccctgcgcctgtccagcacacagccacgtcttca

SEQ ID NO: 323112 - DNA, 886 bp, Homo sapiens
aacaacttatatagtgtgtaaggaactcaagagaaaccagtgagcgagcctttatgtgaaccactgaaacaatctcttaaaaataaggcaattcttttctaagtcaaattcatctcgtgccgaatcggcacgaggtgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaacaaaaaaaaaaaaaaacaaaaaaaaaaaaaaaaaaaaaaaaaacaaaaaaaaagggggggggggccaaaaaacaaataccccagggggggccaccaaaagagaaacacacaccattatattggagaaaaagaggggcgccacaaagggagcggcaaaaaaga

SEQ ID NO: 323113 - DNA, 624 bp, Homo sapiens
  misc_feature (25)..(26): n is a, c, g, or t
ggtggagctcaaggatccttaattnnttaatcccccccccccccccccgcccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttgtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323114 - DNA, 426 bp, Homo sapiens
tgactctagagtgatcccttgcagtggtgactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323115 - DNA, 616 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323116 - DNA, 813 bp, Homo sapiens
ggacgcgtgggtcgacccacgcgtcggacccacgcgtcgcggacgcgtgccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctcgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaaaaaaaaaaaaacaaaaaaaaaaaaaaaaaaaaaaaacaaaaaaaaagggggggggggccaaaaaacaaataccccagggggggccaccaaaagagaaacacacaccattatattggagaaaaagaggggcgccacaaagggagcggcaaaaaaga

SEQ ID NO: 323117 - DNA, 865 bp, Homo sapiens
ggacgcgtgggtcgacccacgcgtcggacccacgcgtcgcggacgcgtgccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgcttcaaccccccaggttggccttaaccccggaatggaaccaaaattggtggtgtgtgtggcccccccccggggggacaaaaccccgtggtcgtggcccgcctcggggaaaagggtccccccccaaaactttttccccccacaaaattttttcccaacgcggaacatttcaaaacattgggaaccacgggggggcgctttgtgggggcgggggggggcacaaaaggggggggggaaaagggaaattccggggccgggggggcccaaggccaaggtggccggccgggccgggctgtcaaggcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323118 - DNA, 150 bp, Homo sapiens
ctctggcacctgttcactctctctctccccatcccccagtataactacggcttcgtggtggagaagaccgcggctgcccgcctgccccccagcgtctcatagtccctcacccttccgcggaaagagcccccttactccacctccccgcca

SEQ ID NO: 323119 - DNA, 729 bp, Homo sapiens
agagttggcaaacttttatgtaaagggccttatagtaaatattttaggctttacagggcagatgatgtgttttgcatattcaatttttttacaattccttaaaaatgtaaaaatcactcttaacacatcagctgtatgaaaccaggccttaggcttggtgtggtggttcacacctgtaatcccagcactttgggagcctgaggcgggcagatcacctgaggtcaggagttccagaccagcctggccaacatggtgaaaccctgtctctactaaaaatacaaaattagctgggcatggtggtgggcgcctgtagtcccagctacttgggaggctgaggcaagagaattgtttgaacctgggaggcggaggttggagtgagctgagattgcgccattgcactccagcctgggcgacagagtgagactctgtctcaaaaagaaaagaaaagaaaacagaccttgagccagatttggctcatgggtgctagttgtccaacctctataggattagagggctcacggaaagtaagttttgagggccacgatgggcacccagctctgtccgattccacagctagccaccccatgaatgcagcttcatatcaccaaagatcagcctactccagcggttcctaaaggctgcatggaatcccctccttcatctataccattcatgatttaaccactcctcccaccccatccccaatgttgtccatgtggctgccttaaa

SEQ ID NO: 323120 - DNA, 724 bp, Homo sapiens
  misc_feature (25)..(26): n is a, c, g, or t
ggtggagctcaaggatccttaattnnttaatcccccccccccccccccgcccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaacaacaacaaaacaacaccaccacaaaacaaacacaacacacaaaaag

SEQ ID NO: 323121 - DNA, 679 bp, Homo sapiens
  misc_feature (21)..(21): n is a, c, g, or t
acgataggctagtcgaggccnggggttcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaagtcgacgcggccgcgaatttagtagtagtagtcgacc

SEQ ID NO: 323122 - DNA, 812 bp, Homo sapiens
tctattactactactaaattcgcggccgcgtccgcccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaacaaaaaacaaacacaaacaaaacaaaaaactccgggggctacctatggggggggggggaaaacggggttctggaaggggccttggggccaaacgggtttcctggaccaagttttctggtcccaagggggaaatccggcgggccccctattgggg

SEQ ID NO: 323123 - DNA, 445 bp, Homo sapiens
  misc_feature (18)..(19): n is a, c, g, or t
cggacgcgtgggtcgacnnacgcgtcgagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323124 - DNA, 258 bp, Homo sapiens
gcggccgcctactactactactgctcgaattcaagcttctaacgatgtacgggggaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323125 - DNA, 1008 bp, Homo sapiens
  misc_feature (1008)..(1008): n is a, c, g, or t
acaagcgctgcagaatatgattccacgtcacagcgccaggatttgtctcactgttgtaacagtctgtcggagtccatccgcccgtgcaccatgacctcagttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaagaacgaaatactcgaacaatactattaagtatcacacataatgacaaaacactataactactacttattgggtgggcccatatctgtataatacacttcaccccaatgagagccacaacattacagcactacaccacgcgcgttttgttggtgtacacatcggtgcgcgccccaacatagtgaaggaagagcgaaatttattcacagccagcgggccacgcaagagcgcgcaatgagtcagatacttaacacacaaggtccgacacgaagagaatcgttaggcagtaagcacaccacacagtctagaatcaacagccagaaggagaaaatcaactttagttaggaagaaagcagaaaacccaacatacacaactctatcaaagggaggtagcgtaagacaaaaaaatctgggggggtgtagtacactccaatctcccaacacacgaacgagaagctaattacagacaggcacctagtcagtctgagatgatcagcattaattatgtaccaactataaccacaaattcgacaataacatagcgaaggcn

SEQ ID NO: 323126 - DNA, 495 bp, Homo sapiens
attattatggcataaactattagtgctgaggccccagtctgtacacttccatgtaataacttcacagtttcatatcttcgtgagatacttactgatttcaagtcccatcttggtcacaaggagttgtgaattagaggacaagtaatatcaccagaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacactccaagatcaagtccccgcataactcgcaagatcctgtagatcaccgcagcac

SEQ ID NO: 323127 - DNA, 1447 bp, Homo sapiens
ttccggcggaagttgctgggcgcggaaagccggcaagacctttttttccgccatcatcgctcacgcgcgcaaccctggcgacgcgtggtggcgaggctccgcctccccacgccattggccagcagctcctcgggcacgcgtatactgcgcttccgggcaatctccgccccccccccccgcatggccttctgggagttgtagttcggtcgcgagcgctgccgtcgggaggcgctccgaggttcgaggctgtgccccgcgaccccgccttcggcgctcggctcgcaggatggatcccgtacccgggacagactcggcgccgctggctggcctggcctggtcgtcggcctctgcacccccgccgcgggggttcagcgcgatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggcttcgtggtggagaagaccgcggctgcccgcctgccccccagcgtctcatagtccctcacccttccgcggaaagagcccccttactccacctccccgccagcctggggccaccccccctcactgcatcctggggccacccccactcactgcatcctgggaaccttcgccctgcaaggcgtttgctatcttcagccactgggcggagctgcagccctggaggagggggcgggtcgaggctgcgtggtgatggggtctccgcccccacgccctgccgggcagggctggagctggacagaagccagtgcctttaagtcatttgtgtcaaaaccctctggggtccggaggctgtgcgggtgtcctcctggcaataaacactacccggttctcgcc

SEQ ID NO: 323128 - DNA, 1602 bp, Homo sapiens
ttccggcggaagttgctgggcgcggaaagccggcaagacctttttttccgccatcatcgctcacgcgcgcaaccctggcgacgcgtggtggcgaggctccgcctccccacgccattggccagcagctcctcgggcacgcgtatactgcgcttccgggcaatctccgccccccccccccgcatggccttctgggagttgtagttcggtcgcgagcgctgccgtcgggaggcgctccgaggttcgaggctgtgccccgcgaccccgccttcggcgctcggctcgcaggatggatcccgtacccgggacagactcggcgccgctggctggcctggcctggtcgtcggcctctgcacccccgccgcgggggttcagcgcgatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaatagggtagggccaccccccagtgtctagccaccttccctgccctcccaactcatgatctcaccaatctgaccctcaaggacacccctgaggtctcctgttccttcttctaccttctgagcctcagattctgcatgttaaaaccgggacatatatatcatcttgtaggactgtcattaggagtcagtgacttggtgtctaaagtagacataacaggactgggcgcggtggctcacgcctgtaatcccagcactttgggaggctgaggcgggccgatcacaaggtcaggagatcgagaccatcctgactaacatgttgaaaccccatctctactgaaaatacaaaaaattagccgggtatggtggcacacgcctgtagtcccagctacttgggaggctgaggcaggaaaatcacttgaacctggaaggcggaggttgcagtgagttgagatcgcgccactgcactccagtctggggcgacagagcgagactccgtctcaaaaataaaataaaataaataaaaataaagtagacagaacggtgatttgaacccagcagtattagtttggtgtggtgcttcgggtgtgggtcaagatgctgaaacaaaaatcccccaaaagactgggcacggtggctcacgcctgtagtcccagcactttggaaggccaaggcgggcggatcacctgaggtcaggagttcgagaccagcctggccaacatggtgaaactccgtttctacttaaaaaaaaaaaaaaaaaaaaaaaattagctgggcatggttgcctgtaatcccagctaatccagaggctgaggcaggagaatcgtttgaacctgggaggtggagattgcagtgagtctagattgcgccattgcactccagcctgggcaacatgagcgaaactccgtcccca

SEQ ID NO: 323129 - DNA, 841 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaaaaaaaaaaaaacaaaaaaaaaaaaaaaaaaaaaaaacaaaaaaaaagggggggggggccaaaaaacaaataccccagggggggccaccaaaagagaaacacacaccattatattggagaaaaagaggggcgccacaaagggagcggcaaaaaaga

SEQ ID NO: 323130 - DNA, 706 bp, Homo sapiens
tagctagtgagctgggggttatcggcacgaggccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaacaacaacaaaacaacaccaccacaaaacaaacacaacacacaaaaag

SEQ ID NO: 323131 - DNA, 1045 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaaaaaaaaaaaaaacaaaaaaaaaggggggggggggggaaaaaaaattccccggggggggccccaattttgcgggccccccgtttttttttgtcaccacgggggtgccccccatagggggaggcggtatatataaagcgcagggacagcgggcccgtggtgttaacacaccggttgtggacgggcagacctggcttcgcttggacctttctggtgagggcccccttacttgtggcgctgttgccctgcctcgcggccgcacttcctggggatttaacgcccggggaatttacaattgcggtggtacggtggcaccaccccatttgcttgcgctcgaaatgtgtcacggcttttctgacata

SEQ ID NO: 323132 - DNA, 723 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaagtcgacgcggccgcgaatttagtagtagtagtcgacc

SEQ ID NO: 323133 - DNA, 770 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgctaaactcaggaacgccccggtaaaaaaccacagatacacacaatactaaaaataaactaaaaaaaaaaggggggacctccaacacaccaatcccg

SEQ ID NO: 323134 - DNA, 736 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgtaaaattttttttttttttttaatgtcgactggccgctttttttgttgttgtatgggctcgt

SEQ ID NO: 323135 - DNA, 759 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaaaaaaaaacagcaaaaaaacaaaaaaacaacaacaaaacaacaccaccacaaaacaaacacaacacacaaaaag

SEQ ID NO: 323136 - DNA, 845 bp, Homo sapiens
tagctagtgagctgggggttatcggcacgaggccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaaaaaaattcagaggacatccaatgtcggagttcgcgaacaacgagaggtcctgacatcggcccatgggtcatagctggtaccgtgaccaagtttcttggaccaacgggggtaaatctcgcggatccccaattagagcgtcgataatttcagataagcccggtaacctgttatgctggcgcaa

SEQ ID NO: 323137 - DNA, 835 bp, Homo sapiens
tagctagtgagctgggggttatcggcacgaggccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaacacaaacaaagagacaacaaaaaaaaaaaacagaacaaaaagaaaaagagagggagaaaaagaacaaagaggaccagaagcagaccagaagtagcagaagacacaagggaggaaagagaacgagggggagaaaagagagggaaacagagaggactagggagagaaagtggacgaa

SEQ ID NO: 323138 - DNA, 748 bp, Homo sapiens
tagctagtgagctgggggttatcggcacgaggccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgctaaactcaggaacgccccggtaaaaaaccacagatacacacaatactaaaaataaactaaaaaaaaaaggggggacctccaacacaccaatcccg

SEQ ID NO: 323139 - DNA, 711 bp, Homo sapiens
tagctagtgagctgggggttatcggcacgaggccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgtctcaggaaccgccccgatacaacttttgcaggcttaagcaatgcggccccgattcgct

SEQ ID NO: 323140 - DNA, 583 bp, Homo sapiens
atcctgattaaatgtctgaaaaaagaaccaagaaaaggcgtttttgttttcaacaaactttactaaataaccgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacactccaagatcaagtccccgcataactcgcaagatcctgtagatcaccgcagcac

SEQ ID NO: 323141 - DNA, 1294 bp, Homo sapiens
  misc_feature (25)..(26): n is a, c, g, or t
ggtggagctcaaggatccttaattnnttaatcccccccccccccccccgcccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtatggagaggccggggctacgtggggtctggagtggatttgcgcctcttgggacatcgtgcatctcaagaattaatcagacatcgaacgggtgcggtagctcaacgcctgtaatcccatcacatcagacatcagagccccgggttgtgtttctgcctgggtcacgggactggagcagagcttatgtgccatttccctgattagaaagccagggacccagggagcgggtgggtggcatggtgggacaccttggttggtgctgtcttccctgggccctgtctgttaagtgaggagaggtgatggctatctggtcagtgggtggtagctaggttggcccagacaggttccaggagacttgagttcaggaactgcatctggggctgggttggtgtccgtggcagaagcctggacttcaggctgttgccatgggaagttcccttacctcacgctccctgaggatgcctgaaggtaggtggggctgggaaactgaggcacaagagtctggccatagagtaggcctggagcctggggtgtgctttagaggcagagggttcagtgaggatggggctagggcacatcggcttgctgctctcacatctccctgggtgccgtgtgacttggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323142 - DNA, 1726 bp, Homo sapiens
  misc_feature (25)..(26): n is a, c, g, or t
ggtggagctcaaggatccttaattnnttaatcccccccccccccccccgcccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtatggagaggccggggctacgtggggtctggagtggatttgcgcctcttgggacatcgtgcatctcaagaattaatcagacatcgaacgggtgcggtagctcaacgcctgtaatcccatcacatcagacatcagagccccgggttgtgtttctgcctgggtcacgggactggagcagagcttatgtgccatttccctgattagaaagccagggacccagggagcgggtgggtggcatggtgggacaccttggttggtgctgtcttccctgggccctgtctgttaagtgaggagaggtgatggctatctggtcagtgggtggtagctaggttggcccagacaggttccaggagacttgagttcaggaactgcatctggggctgggttggtgtccgtggcagaagcctggacttcaggctgttgccatgggaagttcccttacctcacgctccctgaggatgcctgaaggtaggtggggctgggaaactgaggcacaagagtctggccatagagtaggcctggagcctggggtgtgctttagaggcagagggttcagtgaggatggggctagggcacatcggcttgctgctctcacatctccctgggtgccgtgtgacttggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaaaaaaaaaaaaacaaaaaaaaaaaaaaaaaaaaaaaacaaaaaaaaaaaaaaaaaaaacaagaggggagcggcgccacaggtgaaacgtcggcggaggagagggggatctgtggccgcgcggacgtggcgggcggggcacaaggaggtggagggagagtaaagggggcggaggggtggcgtgacatggggggacacggcggacgatgcaaggagggcgcgccggggcatgagggaggcggaggagaaaaggagacggtcggacgcagccacggacgaaggcagccaaatcgacagcgaggcacaacgaccaacagagggcgataccacgaggcaggagcgggacatcgggagggacacaagcgggccgtccacagccgcgccggaaaacacggcacctggacagagaagagcacacgcgtg

SEQ ID NO: 323143 - DNA, 669 bp, Homo sapiens
ggacgcgtgggtcgacccacgcgtcggacccacgcgtcgcggacgcgtgccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323144 - DNA, 655 bp, Homo sapiens
tctattactactactaaattcgcggccgcgtccgcccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtg

SEQ ID NO: 323145 - DNA, 4290 bp, Homo sapiens
gagacattccggtgggggactctggccagcccgagcaacgtggatcctgagagcactcccaggtaggcatttgccccggtgggacgccttgccagagcagtgtgtggcaggcccccgtggaggatcaacacagtggctgaacactgggaaggaactggtacttggagtctggacatctgaaacttggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccctttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctgggctgga

SEQ ID NO: 323146 - DNA, 4870 bp, Homo sapiens
attcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggtgccttaattccgcggttcccacgcacgcttaactaagacgtgtctgtattcctcccgttacgtgaaagagttcggagctttgcctgggacccccatcattccctccctggcacaccccttccagaacgccccgccccactgcatattatttacccctcctggccacgcgggggaagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccctttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctgggctgga

SEQ ID NO: 323147 - DNA, 4815 bp, Homo sapiens
attcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggtgccttaattccgcggttcccacgcacgcttaactaagacgtgtctgtattcctcccgttacgtgaaagagttcggagctttgcctgggacccccatcattccctccctggcacaccccttccagaacgccccgccccactgcatattatttacccctcctggccacgcgggggaagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccctttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttattcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctgggctgga

SEQ ID NO: 323148 - DNA, 4488 bp, Homo sapiens
attcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccctttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctgggctgga

SEQ ID NO: 323149 - DNA, 2920 bp, Homo sapiens
gaggaagagttgggaaaggtgactgatgttaacatataatgagttactttgttttgtacagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccctttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctgggctgga

SEQ ID NO: 323150 - DNA, 2284 bp, Homo sapiens
attcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggtgccttaattccgcggttcccacgcacgcttaactaagacgtgtctgtattcctcccgttacgtgaaagagttcggagctttgcctgggacccccatcattccctccctggcacaccccttccagaacgccccgccccactgcatattatttacccctcctggccacgcgggggaagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattatttt

SEQ ID NO: 323151 - DNA, 2154 bp, Homo sapiens
attcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggtgccttaattccgcggttcccacgcacgcttaactaagacgtgtctgtattcctcccgttacgtgaaagagttcggagctttgcctgggacccccatcattccctccctggcacaccccttccagaacgccccgccccactgcatattatttacccctcctggccacgcgggggaagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaa

SEQ ID NO: 323152 - DNA, 2795 bp, Homo sapiens
attcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggtgccttaattccgcggttcccacgcacgcttaactaagacgtgtctgtattcctcccgttacgtgaaagagttcggagctttgcctgggacccccatcattccctccctggcacaccccttccagaacgccccgccccactgcatattatttacccctcctggccacgcgggggaagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaaggtaagagactatcccaaaataaaaagctctttgtaatatggctcaaatataagctttcaaaactgctaatatatctatccagacagatttagtaaattatcttatagtttcccttttattacatcatggatgatttttttaaatacaacttttgcttgtaaatcactataattgttttttcctataaatcctagtcagccactccctactgcctcagccaatcagttacactcatggaattgttgaccaaaaagtaataaaaattacatgcattgatgtctgataggcatcacataataaaataagggctaaacatgaattaaaggccctgttccctgtttttggtagattctgaacttcgcagctgcaattattattataactaaattagttcctttttcacatggactgtgagaatagcaaggtaaacaaaaaaaaaatagtttaggttttacctctttcttccttttttgtataacagtgatgtgctgttcaatgtgaaatacatataattccttcttcagctgcttgcattttatcatccttctattcattcactccttcaacaatctaacatgaaataaaatatcccctcccctaatgtgaaaatcatccatttgtccatggtatttcactactggaaagctaagaacgtagctcccgcgtaaacactaaggcagcctataacattcttcgcccactcataactcaaattttagagttggaagagaacttccatcaggatcaacaccctcattttataagacataaaacagtggacttc

SEQ ID NO: 323153 - DNA, 2020 bp, Homo sapiens
attcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggtgccttaattccgcggttcccacgcacgcttaactaagacgtgtctgtattcctcccgttacgtgaaagagttcggagctttgcctgggacccccatcattccctccctggcacaccccttccagaacgccccgccccactgcatattatttacccctcctggccacgcgggggaagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaa

SEQ ID NO: 323154 - DNA, 1334 bp, Homo sapiens
  misc_feature (1278)..(1278): n is a, c, g, or t
  misc_feature (1307)..(1307): n is a, c, g, or t
  misc_feature (1313)..(1313): n is a, c, g, or t
attcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggtgccttaattccgcggttcccacgcacgcttaactaagacgtgtctgtattcctcccgttacgtgaaagagttcggagctttgcctgggacccccatcattccctccctggcacaccccttccagaacgccccgccccactgcatattatttacccctcctggccacgcgggggaagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggaaaacctggcctggaacaatccgncaattgacaatcccctaatcaaatgtccnacaaanccttggctggggcaaaaggga

SEQ ID NO: 323155 - DNA, 1870 bp, Homo sapiens
aaacagccttttgggacctgtccccggacgaggactgcccccctccctcgggcaactactactgatgctgtccaggcatcgcccaaggggaaaggttgcagcggggtcggaaggcgcgggaggagtctggcggtgattgatgggaagggatgaatgaataaaagtacttgtctgatggcagcagagaccccgagcaaacggtggaggctacactgtctggcattctcgcagcgtttcgtcagagccggacccgcctgcagctcaagggaggcgtgctcctctcccagagcaggctggaacccagctgggttccgcctcccgggaaggtggtctccattcgtcgctctgcatctggtttgtcagatccgagaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaaaaaaaaaaattgggggcgggcgaaaatttaaattgtgggggggcgggaataaaggtaggcaaacggggaaggggtcacaaaaacggggggggggaaaggggtgggaaggt

SEQ ID NO: 323156 - DNA, 4429 bp, Homo sapiens
attcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccctttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctgggctgga

SEQ ID NO: 323157 - DNA, 3094 bp, Homo sapiens
attcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggtgccttaattccgcggttcccacgcacgcttaactaagacgtgtctgtattcctcccgttacgtgaaagagttcggagctttgcctgggacccccatcattccctccctggcacaccccttccagaacgccccgccccactgcatattatttacccctcctggccacgcgggggaagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaaggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccctttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctgggctgga

SEQ ID NO: 323158 - DNA, 2264 bp, Homo sapiens
attcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggtgccttaattccgcggttcccacgcacgcttaactaagacgtgtctgtattcctcccgttacgtgaaagagttcggagctttgcctgggacccccatcattccctccctggcacaccccttccagaacgccccgccccactgcatattatttacccctcctggccacgcgggggaagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaaaaaaaaaaattgggggcgggcgaaaatttaaattgtgggggggcgggaataaaggtaggcaaacggggaaggggtcacaaaaacggggggggggaaaggggtgggaaggt

SEQ ID NO: 323159 - DNA, 1380 bp, Homo sapiens
attcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggtgccttaattccgcggttcccacgcacgcttaactaagacgtgtctgtattcctcccgttacgtgaaagagttcggagctttgcctgggacccccatcattccctccctggcacaccccttccagaacgccccgccccactgcatattatttacccctcctggccacgcgggggaagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggacttgccattttgagatcagatgtgccaggtaggagcgttcacccacccagaggagggttgccacag

SEQ ID NO: 323160 - DNA, 186 bp, Homo sapiens
gtccctgtcccccaggttgattggatacaccagttaaaaaagaaaataaaaagaaaaaaaccactggtgtctgggtctcagccccagagatactaactcaattggatcagggtgtagcctacacattgggtttgttagtaaagctccctacctgattctaatgagcacctaagtttgagaactgct

SEQ ID NO: 323161 - DNA, 1000 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgcaaaaaaaaacttaacaaaaaaaaaccgggacaattaaggggacaaaagtaaaagc

SEQ ID NO: 323162 - DNA, 825 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatggcgcctatatcacagcttatggagtcacacacttcttgatgaacatgttggctgtttccagctttttctgtctacacacagcaccacaatgagcaactttgtcccttcctccttgagcaaacgcacttggaatatgtactgactatgtgctggtcatggttctaaatattttgcgtatgttaactcattcaaccttcacgcaaaccctaagaggcagaaattaccattgtccccattttacagacaaggaaacagaggctgtgagtaactggttcaaggtctcacaacaagtcagggacgcagctggaatcgaagtccaggaatctggcaccagagcctgtgcttttatccaagacaatacagggcaaaggacatgcatgcttaatgttttaaaatttgccctcctgccgcccaggcacagtggctcatgcctgtcatcccagcacttttggaggctgaggcgggtggatcgcttgagcccagg

SEQ ID NO: 323163 - DNA, 767 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccaggtgaggaaagggacacatctatcaagatcctgtcattgcaaataacaacagcaacaaaaatcccaaacttggaccaaacaagggaatttatggatttatgtaacgaaaaagtccaggaagagtctcctctcatggggccaagatgatcccttgaagcctggggctgtcatcctgtctgctaagaatcccagcaagagaatttcctttccccagtccagcaaatgtcccagaactgagttatctttggccaggctcaggtcgtatccctgagctggccactgtggccacaggcatagaaagctgattggccaggcctgggttccatgtccaacctccaccagggctggtgtcagccccgctgaataaagtggaccaagagtcagggaaggatggtccctaaaggaagttctgggggcttttatcagagcaggtgcatttgggaagctgagttaaacatgtttttttaggcagcacttctcagag

SEQ ID NO: 323164 - DNA, 1005 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacgtaagtccctctcgcgcgccacctccatccgctgcccctctgcccacgggccgggctcagatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgc

SEQ ID NO: 323165 - DNA, 1108 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgcggcaaaaaaaaaaaacaacaaaaacaacagcggggggcgcaaaaagattcccgagggggccaatagcagcggaccccccttttgtgcacaggggcccaaagagagcttaaaacaggcagggggtttaacctggtgggaacgcatggatggaagaccccctggg

SEQ ID NO: 323166 - DNA, 892 bp, Homo sapiens
atcaggtggtactgagctcaggataagagtaacggcgcagagtagctgaatacggctaatctgtaggaggcatgagcgaccacgcccagctaattttgtatttttagtagagacagggtttctccatgttggtcaggctggtctcgaactcccgacctaaggtaatctgcccgcctcggcctcccaaagtgctgggaatacagacataagccaccgcgcccggccccaattctctttccccagtgactctttcttatccttccctccttgctctcctgacctgaatagaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgc

SEQ ID NO: 323167 - DNA, 1572 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacgtaagtccctctcgcgcgccacctccatccgctgcccctctgcccacgggccgggctcaggtgggtaggggtttgaccccttccgctcctctccgccccccatccacgcccacatctctctgcctcctctcctgggctacagtgggccgctctgcctcgctcccgcccgcctgcctcagtctccccagctctctgccacccccctcggaccagtgcctcttaggtctctccagcgcgccatccctgcaaggcggcccctgacaccaactcactttttcctctgagcgcgggaggcgttactcactcttcctccttcccctcctcgccgactcccgggctctgggcccctgggggagggaagaggcctcctatctactcctctgccccagtcccctccttgcgtcagtcccagtgagggataagcgcctggcggaaggcgcagggaggtgtttctctgcttcaggagtgcccgccggcccttgcagctgctggaagacccatttatctcatgcttcttgttttctttggggacctgcaggggaaggaagcagggtgacggtttggtatccccacctaagaccctcccctttcccctgaggccagccgtcagcccctggcagggggtcttggaagccagaggtttttgctcagggcagggaaagggctgcaggatccccgggggctgccggaggtcggtctcactgacatcatggctgaccccagcatcgcctggtcccacagatgtcgccctctggtcgcctgtgtcttctcaccatcgttggcctgattctccccaccagaggacagacgttgaaagataccacgtccagttcttcagcagactcaactatcatggacattcaggtcccgacacgagccccagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgc

SEQ ID NO: 323168 - DNA, 852 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgc

SEQ ID NO: 323169 - DNA, 911 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgc

SEQ ID NO: 323170 - DNA, 761 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccagtttgtcacaccaagcaacgtaccgttgttcggga

SEQ ID NO: 323171 - DNA, 656 bp, Homo sapiens
tttctccttgttggtctttccccatagaaagacaactctgccagggcagggatttttttctttgtcctcaactgtgttcttagtgcctgaatgaatgaataagtgagatacaaaataatgggagtttccaaacggctcatctgtgagcctgtgtgggaagggcctctcgcagggccccagcactggctgttctcggtgtgtttctccatcatttgtttatggagttgcctttgagtttcccgaggggcagggttgatcaatctggttccccagccccacaacacacgataagaatcaatatcactctagctcgtgactgaatcatttccttcacccacaggtggcaagtgcaggcagctgtcccggttatgccggaatcattgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgc

SEQ ID NO: 323172 - DNA, 571 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatcttgagcctgtgtctcatcttatatttggaatgactattaaaaaaacaacaatgtgcaatcaaagtcctcggccatcttgagacctggtgccggc

SEQ ID NO: 323173 - DNA, 636 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcaggtatagcatgggactgagagcagcagcctacgatttttgtttaattctctatctaggtcaacatttccctcagtacgtttctcagtgcccctgtttggggaattgttaatacatttaaaaaaaatgtttttggtttgtggtcaaagttatttggggaaccctgagttaaagttaaccatgtttctttgtggcaggacttctg

SEQ ID NO: 323174 - DNA, 945 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgc

SEQ ID NO: 323175 - DNA, 632 bp, Homo sapiens
tgcacaccagctgtgtagatgtgggagaggggtttcttccagatgcagactctcagtaatatcccttgtttctgcctccatggctcactcctgccctccactgatctggccactctctcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgc

SEQ ID NO: 323176 - DNA, 1686 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacgtaagtccctctcgcgcgccacctccatccgctgcccctctgcccacgggccgggctcaggtgggtaggggtttgaccccttccgctcctctccgccccccatccacgcccacatctctctgcctcctctcctgggctacagtgggccgctctgcctcgctcccgcccgcctgcctcagtctccccagctctctgccacccccctcggaccagtgcctcttaggtctctccagcgcgccatccctgcaaggcggcccctgacaccaactcactttttcctctgagcgcgggaggcgttactcactcttcctccttcccctcctcgccgactcccgggctctgggcccctgggggagggaagaggcctcctatctactcctctgccccagtcccctccttgcgtcagtcccagtgagggataagcgcctggcggaaggcgcagggaggtgtttctctgcttcaggagtgcccgccggcccttgcagctgctggaagacccatttatctcatgcttcttgttttctttggggacctgcaggggaaggaagcagggtgacggtttggtatccccacctaagaccctcccctttcccctgaggccagccgtcagcccctggcagggggtcttggaagccagaggtttttgctcagggcagggaaagggctgcaggatccccgggggctgccggaggtcggtctcactgacatcatggctgaccccagcatcgcctggtcccacagatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgc

SEQ ID NO: 323177 - DNA, 1076 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggttggaacagactgtgggggcggagacaggagcagggagcccaagaaggaggctgctgggatgtccaggctggagggtacagaggcaggaccaggatgggggcagtggagttatccagcactgaccacatggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgc

SEQ ID NO: 323178 - DNA, 1061 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccaggtgaggaaagggacacatctatcaagatcctgtcattgcaaataacaacagcaacaaaaatcccaaacttggaccaaacaagggaatttatggatttatgtaacgaaaaagtccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgc

SEQ ID NO: 323179 - DNA, 788 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccaagccccctgccagctcaccgtgcccagcctcctgaagcagtgcacaagatcctctagagtac

SEQ ID NO: 323180 - DNA, 886 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgc

SEQ ID NO: 323181 - DNA, 825 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgc

SEQ ID NO: 323182 - DNA, 1396 bp, Homo sapiens
ggaaacccaagaggaaatgactgagcccgtctgggtccccgcccgctcgcgctcccctggccacaccctccgcctggacgcagcagccaccgccgcgtccctctctccacgaggctgccggcttaggacccccagctccgacgtaagtccctctcgcgcgccacctccatccgctgcccctctgcccacgggccgggctcaggtgggtaggggtttgaccccttccgctcctctccgccccccatccacgcccacatctctctgcctcctctcctgggctacagtgggccgctctgcctcgctcccgcccgcctgcctcagtctccccagctctctgccacccccctcggaccagtgcctcttaggtctctccagcgcgccatccctgcaaggcggcccctgacaccaactcactttttcctctgagcgcgggaggcgttactcactcttcctccttcccctcctcgccgactcccgggctctgggcccctgggggagggaagaggcctcctatctactcctctgccccagtcccctccttgcgtcagtcccagtgagggataagcgcctggcggaaggcgcagggaggtgtttctctgcttcaggagtgcccgccggcccttgcagctgctggaagacccatttatctcatgcttcttgttttctttggggacctgcaggggaaggaagcagggtgacggtttggtatccccacctaagaccctcccctttcccctgaggccagccgtcagcccctggcagggggtcttggaagccagaggtttttgctcagggcagggaaagggctgcaggatccccgggggctgccggaggtcggtctcactgacatcatggctgaccccagcatcgcctggtcccacagatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgcaggacaatattacaaaagtgaacaaatgcaacctttttctgcttttacagatgacatgtctccatccccggccagcaggggtaggggaggccggttgaaagtgacactccgttaaaaaggcaacaacttttataaaatgaagactaaggaaacagcccagggttcggaagctgagatgctaccctgggggtagagcatagacatgggtcgggcagaccttgtctcctttcacggcattcctgggagggtaagaagggctgtcgtgctcagggccagtggggactgaatccaggaggccccttggagatcccag

SEQ ID NO: 323183 - DNA, 613 bp, Homo sapiens
ttttaaataccccaggcaaagttactaaccagcagtcttagaatgagaatgctttccagtgggacacatcatttatttaattcagttttatcaatctgaaagcctcatagctgaatactaaagaagagttgagctttgaggagaagcagagtatttcatcatggttcaaaccagtatctgaaacaagtaggtttctagggagaaaagataatctcttaccaagcatgtcagttcacctgccttcatcaaaggactgactgcataggtgttaacaatcataattctgaaagttgctctttgatatcagtatattctataatgtattattggcttttaaatacctcaccctcctcacagtctgtaggacatttttatttaacttcttgatttgaatcaaagcagctattacttcattagctcttttgaagtgttcttggttgagaaggaacagcaaggcttatagaagaaagccaacttttcaaatcagtctttcttttgatcagcgctgaatctgatactacactgtactttaatcagaggaaaaaatggagatttgccttttttctatggaaaatttatcccataatgagggaaagggaataaaagatatagc

SEQ ID NO: 323184 - DNA, 1237 bp, Homo sapiens
aaaaagacaagagggaaagtatttctcttgattcttggttaaatttgtttaataataataatatcctaaaaaaaaaaaaaaagggcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaattttt

SEQ ID NO: 323185 - DNA, 404 bp, Homo sapiens
caccagagaagatttttttgttctaccaggtgcctaggaatgctaacagtctgggaccacatagaccaccaggtgatgagacaatcctgggagtcctgttttactttggcccatcttttctcccaaccctgtgggaatagtcattcatatcctagctgcaagctagaaggtggtttatcagagcccaacttcgagggctctgggctttagctactgtcaccccatcataactgagcttcatggattgattctctttttatctttcagattttcttttaaaaatctttgttttttttttttcttccgaaagattcccccaacattaccattccccaccttccgttgaatttttttggctctcattttgaatttttcaagagctcatgttctttgtcttcattaaa

SEQ ID NO: 323186 - DNA, 389 bp, Homo sapiens
ttaagggtagtttggtaaagaaagctgaaatttatttaaaatgactcaggtatctttagaattctcaaaagctgcaggaaataagagtctggtaccctgagaagcatggggcagtagaaagagcatgtgggctttagagttcaaaccaagtcaggctcaaacatagttctgtgataagccctgagcaagttacccgggtcttccatttcccccttctggagaagtcctttggaggatgagtccttctggaggatgagtccttctggaggatgaagtccttctggaggatgagttcgttgtaagaataaaatgagaatgtaagacacctagaggatgcccgagtaaaaaatgacagttgctagtagtagtaatttgtagggctcattatc

SEQ ID NO: 323187 - DNA, 2131 bp, Homo sapiens
  misc_feature (2072)..(2072): n is a, c, g, or t
  misc_feature (2118)..(2118): n is a, c, g, or t
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaaatncgtccagttttttttcatcttttatttcccccctctttttcttccntttcttttctctt

SEQ ID NO: 323188 - DNA, 3248 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccaggtgcctaggaatgctaacagtctgggaccacatagaccaccagaaattgccacagccaccccagccttcagcaaccaccacactgatcagtcagcagctgtcaacattgagctactcagctctgctgttgtagtgtgaaagcagccacagaaaatatttaaattattccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323189 - DNA, 1892 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatccctttaacaaaacaaaaaaaacttttttgggggggggggggggggccccaaaaaaaaaaattttttttataacacccaataatacttttttttctttgccatttctagaagagaggaggggggggagcaagattttcaacaaagaggacgagggggggggagcacacacacctttttttttaattttgatatcttatttattatctctcaaaaacaaaagcaacggggggggggagaagagaagaggaaaggtattttttctcccccccccatttttttttgggggggggga

SEQ ID NO: 323190 - DNA, 1431 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaattttt

SEQ ID NO: 323191 - DNA, 3365 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctggtacgtaccgatgaggcggcggcgggccggccctgggctggggtcgccgcccctgcactcaggtaacaagctctgggtggtgcagctcggacgcttccgtttcctaacttttagactcttccctgaaaagaagttactggcaggtcattcggtcgggatgaatttcagggtcaccagcggggtccacctacggtctctgtggtcaagttagaaatcctctcatcccccttctatctgcacccgttgctggaagggccgcctctgcatattgcattgataaagtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323192 - DNA, 3235 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgaagttactggcaggtcattcggtcgggatgaatttcagggtcaccagcggggtccacctacggtctctgtggtcaagttagaaatcctctcatcccccttctatctgcacccgttgctggaagggccgcctctgcatattgcattgataaagtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323193 - DNA, 2749 bp, Homo sapiens
  misc_feature (55)..(55): n is a, c, g, or t
gggccctgccccgggcgcggggctccgatggacaaacaataatgacactccttcngaaacttcttgtattttctttgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323194 - DNA, 2620 bp, Homo sapiens
ctggcaggggtctcaactccactgatagctaaagcatgttggggtttgaatgctggatactttgaagttgccatatcctgactgaagtccttcccagaacggcagtagttggtcgagtatgccacaggttatctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323195 - DNA, 2642 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctgggtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323196 - DNA, 2339 bp, Homo sapiens
taaaatttctatttgtgaaaacagcagtttgtggtaaggctgaatgacatattattgtattcataatgcatattagtactcttcagaatcccagttaaaattattttatgtttgattttcagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323197 - DNA, 2672 bp, Homo sapiens
gagaaggatgaaaacaaattctttggcttatatgttaattagagagtggaaggcaaatccaagttaatttctacttagatttatgtccactgaacttagatctgtgtgtatttgttctgccacatttttgtattattttatttttattattttatttattttgtattattatattttgtattattatattgtttctggtttaccatctggtaaattcttatttctggtttaagtcaatttctagaatattctgttaagtttaccgttttcagtgtaaaaacctatagtgttgatgttaaccatttttaatatgtaaacgattttatgaactatttccctttaatgctaataaaacttgtccatgatgtctggctttgtgggctatgtgatctctgttacagctactcagctctgctgttgtagtgtgaaagcagccacagaaaatatttaaattattccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323198 - DNA, 2469 bp, Homo sapiens
cacaatgtgaattgcagaatgggtttagtctgggacacagtgttgaacaaaatttttaattggattgtttatccatttgttggagttcttaatatattattttgagggctgtacatgctgcaaatgtattttccctctgtgtggcttgccattttagtctcttaatggtgtcttctggacaccaaaagttaaacgtagtcaaatatattagtcttttcctttatgattattgcttcttaattttcatttaagacatctttttctaatttgatgacctgaggttacttttatgttactttttagagcagtgctgttcaataaaagtatgagctgagccactcatgtagtttaaaacattctagtatctgcattaagagagcaagacgcatcttgctcccatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323199 - DNA, 1241 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccaggtgcctaggaatgctaacagtctgggaccacatagaccaccaggtgatgagacaatcctgggagtcctgttttactttggcccatcttttctcccaaccctgtgggaatagtcattcatatcctagctgcaagctagaaggtggtttatcagagcccaacttcgagggctctgggctttagctactgtcaccccatcataactgagcttcatggattgattctctttttatctttcagattttcttttaaaaatctttgttttttttttttcttccgaaagattcccccaacattaccattccccaccttccgttgaatttttttggctctcattttgaatttttcaagagctcatgttctttgtcttcattaaa

SEQ ID NO: 323200 - DNA, 539 bp, Homo sapiens
attgtattcataatgcatattagtactcttcagaatcccagttaaaattattttatgtttgattttcagttccacttacttacatgatcatttcgagagatgtaatgttgattgctgctgttttttatgtcagataccgaactcttccaacaccagtgagtttgtttccaaaaagtattcttttagcattatatatgatttaaggaaaaagcaaaaagacatatttttgcgtcaacatcttttcaattgatggcacgtgaaacccagactagccagcccctatccctagaagcaaattctttaaaggtgtttcatataggtccaggccatattgtctaatttaacctctaccatggatagtctagaattggttttaaaaatcacagttgtatgaacatgggatggtttgtttgcatatttattcacaggctctataaatacttgaacacatacgcatagcatattaacctcttttggctcccaatgtactgaaaatagagcagtagagcagtattttgttcattttattttttaattca

SEQ ID NO: 323201 - DNA, 3083 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323202 - DNA, 2884 bp, Homo sapiens
cgcctcccccccccccccaggagcgggggggaaggactaacaagacgagcgctctggatcttactaaaggaataagcgtgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323203 - DNA, 2889 bp, Homo sapiens
aaaaagacaagagggaaagtatttctcttgattcttggttaaatttgtttaataataataatatcctaaaaaaaaaaaaaaagggcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323204 - DNA, 2123 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaacccgatgcgtccaacggtctttcttctgtagggtgttagtttgctactacgtgc

SEQ ID NO: 323205 - DNA, 2130 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagcccgatgcggcacagctcttttgtgttacttcctctattaaactatatctattataagct

SEQ ID NO: 323206 - DNA, 3029 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323207 - DNA, 3083 bp, Homo sapiens
  misc_feature (1416)..(1416): n is a, c, g, or t
  misc_feature (1447)..(1447): n is a, c, g, or t
  misc_feature (1460)..(1460): n is a, c, g, or t
  misc_feature (1492)..(1494): n is a, c, g, or t
  misc_feature (1527)..(1527): n is a, c, g, or t
  misc_feature (1537)..(1537): n is a, c, g, or t
  misc_feature (1540)..(1540): n is a, c, g, or t
  misc_feature (1549)..(1551): n is a, c, g, or t
  misc_feature (1570)..(1570): n is a, c, g, or t
  misc_feature (1577)..(1577): n is a, c, g, or t
  misc_feature (1595)..(1595): n is a, c, g, or t
  misc_feature (1597)..(1597): n is a, c, g, or t
  misc_feature (1610)..(1610): n is a, c, g, or t
  misc_feature (1622)..(1625): n is a, c, g, or t
  misc_feature (1636)..(1636): n is a, c, g, or t
  misc_feature (1639)..(1639): n is a, c, g, or t
  misc_feature (1642)..(1642): n is a, c, g, or t
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaacccccccccccttntcctcccccccccccccccctcggtcccccnccccccccctccncgcccccctcttcccccccccctttgtctccnnnccccccccccccccccgcgcctgggccgcattncccccccccnccnccccccccnnnggatcgccccccccgcccncggcccncccctggggcccccctcncnccccccccccccngggccccccccnnnngcccccccccncgnccngtgtcccccttccccgttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323208 - DNA, 1709 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctctttagtgaattggtgttcccagcctagaagtctgggtcctttttctccccactggcatacttgttgattagcggtactacagcggtttaccgtctggcgacgagggcgtgacgtaaaaggcgtaaacagggtgggccccgccttgtcgccaccgcttcctccttttttctttt

SEQ ID NO: 323209 - DNA, 3145 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctggtacgtaccgatgaggcggcggcgggccggccctgggctggggtcgccgcccctgcactcagtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323210 - DNA, 3026 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323211 - DNA, 2953 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323212 - DNA, 2621 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccaccttatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323213 - DNA, 2319 bp, Homo sapiens
ccccgggctgcaggattcagcacgagttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttattccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattca

SEQ ID NO: 323214 - DNA, 841 bp, Homo sapiens
cgtacccgctgcttcccaaaacccactgagcctgatgcgcgcgcctccgctgtgccaggggcgccgggaagcccgacgacgacggtgtcgtaaaagcgtcgcgaaggcgtccgcccttggcggcttcctgccacctgtataagtggagcgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcactcactggtagcactgtacgatctcgactatggcggctcccatgcccgttgccgctactggcgccgctgatgatgacgaggccgagacaagttgcccatcctgcgcacagacgctgcatgagctgccatgagctctagcacgttagcgataaacgacatgattggcgatggccgagcactggtggatagagttatggcgtagctatattaactggctatagcatttgcgtcatgcaggctgacttattccgtggttggaatgctttggagacgctgctgcaagcaatgatgggccctgttgcaggaactggtcccagtctaattttcagtgacattttgcattatgtcttccgggtggg

SEQ ID NO: 323215 - DNA, 1651 bp, Homo sapiens
  misc_feature (759)..(759): n is a, c, g, or t
  misc_feature (805)..(805): n is a, c, g, or t
  misc_feature (1120)..(1120): n is a, c, g, or t
aacttaaatatattctttcccccaacagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttggtgagtgcttatgttctaggaaagcaaaatgtttgtaagttatgagaagagcagaattcactattgttagtcaaaatcttaaaaacaaacaagaaaaccctgaacccttactttttctcctcttcctctaataagtaccatgtcttgcacaaagacgaatgcaactaggttcttctcctcaaaggagagtctttatattgtaaacattgtgaataattagcaaagtagaaaaggagggaatgctgaggataaggttagtcagtcctcaacactctaaaaaaagccaggcaagcagagtgttttggggagtatataaggacctctgctagtccagggcctgggagaagtgtagcatgttgccctgctggtgagcactggagagcgtttggccaattgatgataccatttggtaccataaaacctgatttgattgaccctggggataacaggtaccaccacactcacagattcttcccttatccatgtcagagtgttggaaagataaagttattttttccacaacattttggggactcctgatatatatttctggtcatattttgaggcaccagtgtntagtccctgattgacttttatttgactctcagcagttctgtctcanccccatagccatgggaatttccttccctcattgtcacagataatgatgttctgaacttctgcctttcccccgtacaacttgtatgaatttggagtacttttagttgtaagtaactgaatacccaagaggcttaaactagaaggacttttattatttccttaataagcaatctggagataggttttagcacttgttctggttgcttgctcattgatgttagggtttgggtctgtgtctgtgattttcttgacttttttcctcacggtggtttgatgcctgccatagcattaagcatcatctcacaaatcagcgccntgagcaaaaagaaataaaagcacgaaaaatggtccttctctccataatgctttgtcagggaagaaagtcctctctggaaggctccacctgacctctgcttatgactcggcccactcctagtccttccaccagcaaagaagaaatttctgtgatgcaccaatcatgatttgtttccagggcctgctttcctgggcatgttgctgcctaattgatactatagaaaagatgcgttctaaccaggtgctgtggctcacacctgtaataccagcactttgggaggctgaggtaggcagatcacttgaggccaggctttgagacaagcccggccaacatgacaaaaccccatctctactaaaaatacaaaaaaattagccaggcatagtggcacacacctgtaatcccagctactcaggagaggaggctgagacatgagaattactcaaacctgggaggtggaggttgtggcgagccaagatcgcaccactattctccagcctgggcaacagtgcaagaccctgtctcaaaaaaaac

SEQ ID NO: 323216 - DNA, 897 bp, Homo sapiens
agcgggagtgcgcggaagacgcatgcgctggcggcctgcgccgccttaagtgccgcgccagcccggggcggcccagtcggcctgtcagccggcttcgagataagtcccggcgcttgcgcggcggcggctatggcggcggaggaggaggaggtggactctgccgacaccggagagaggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttgttacgcagtgccgtaacgggcgacccagcaggctctcgggtccgcaacgtgacgaacatcccgtatgtcacctgggcatgcatctgggtaggggcatccatggttcg

SEQ ID NO: 323217 - DNA, 995 bp, Homo sapiens
gtgtgtgcctgtaatcccagctactcaggagactgaggcaggagaatcacttgaacctgggagacggaggttgaagtgaactgagattgtgtcactgcactccagcctgggcgacagagtgagactccatctcaaaacaaaacaaatgcaaaataaaataaaataatggaaatacctttcttacctgtgagattggggaaaatccaagttaggcaatgcactctgttgagacaatagggaaacaggcactccaaaaattacaaatccctgtggatggtatttgttaactagcaaagttaaatgagtatatccttcaacctggcagacccagttctaagaatccatatgagatgcacttgcaagaatatgaaatagtatatgcacaaagatcttgattacagcactgtttctaatagctacagactggaagccagccaaatctccattgatagggaattgatggaaggaactagggtatatctatacaatgggatactacacagctgtagaaaggactgcgaactatttttgtagttctggtctggagaaatctccagaatataggaaatgaaaaatgtaaagcacagaagagaatgtatggtgtgctgtctgttgtataacgaagagacaaatggaaaaaatatgtatttgctttttttgtaaagcaatagaagaattagttataccaataactaataaaatgatctccttgttagtggtggtagggagctagacaaggatggcaactatttctgtatcttacataccttttattttgaggccctgtcaatgttttatataataaacattttttgaaaaggcaactcttaaaactaaaacaaacttaacagtctgtcaagttggtgatataaccccacagaagacttacttcaagtgacttgaaaacttagtattttgtctgtactttgctaatggaatatatcctacagaccaaacaaccacaaataaatcttaaactgcattcagtagtttta

SEQ ID NO: 323218 - DNA, 5385 bp, Homo sapiens
agcgggagtgcgcggaagacgcatgcgctggcggcctgcgccgccttaagtgccgcgccagcccggggcggcccagtcggcctgtcagccggcttcgagataagtcccggcgcttgcgcggcggcggctatggcggcggaggaggaggaggtggactctgccgacaccggagagaggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttggtttaagtctagtgcagcgtttaaggcctgatttcaaacgaaagtattcttcaatgttcgaagacgatactgtgacagaatacatctaccactgtaatgtgcagactccaagtggtgagacagctttcaagaatatgactattccttatggatgggcaaaaaggccaatgctccagcgaattggtaaaatgcaccctgacattccagtttcagtgatctttggcgcccgatcctgcatagatggcaattctggcaccagcatccagtccttacgaccacattcatatgtgaagacaatagctattcttggggcaggacattatgtatatgcagatcaaccagaagaattcaaccagaaagtaaaggagatctgcgacactgtggactgaacacactgaagctctgatgggaaaacctggtgactgatatagttgttcagcaataattcatagtctgtgatgaagagtagtgaatacaacacacaaccaggcagccttcttgactatactttgcacatgttttctttaggaattcactcacacatttaaaccagttagtgccttctagaagaatggctttcctttctcctacacaaaattgaaatatacaagtctctaaatataatacctttaaataaaaggttatttgtccctctgatgtactgaaaaactgtaatttttcagctgaaaattttttaatctaactttgctagttatttttatattgcaatctatattaccaatttaggaagtgatttctgagtctcttacactgtaaaggtgcactttattttctttgtcttccccatcatgtatttattgtgtcttgataactgatattaatctaaattcaatgtgtttttatgtaaaaatttgtcagttgtttagaatatttcactttgtttttgaaacggagtgacaaggcagatttttggttagaggacgggagttgatcactatcattactttttctagtttacctgttttttatatttaaggctgctaagccatgttcagcattttaaatgtggtctatcctgacatacagtgtataacaacataactccttggaacctcctatgtgtggtataattctactcttccaaggaacatgacttcaatactttcagtgattcaggtactgaaaagccttacctaaaaggctgttctttgtttccccctttcatactattcttttccatgacccaggatgcagcaaatgaaacagatttcttctcttaaggggatattaagactgttacttcctagtaagccaagtaataccatatttttattaacatctaacttttgtagatgggtgctaaaattgcatacattttaaccactaaaatagaaaaacaagtggtgctattatgtctcatggcaccagaaatgagctagcacttgggtttgttgttgctgttgtttattaagagtattgtgttaattaaatcattacatacttgaagttatattacaaaaattctagaaggttgattgaactatttttttaggaactaccatcaagtgtagcattttcttgcagttttaaaatgaggaaaacttctttgaaactgtgaaatgctccatgtggtaactggctgctgagaaaacccttcaccaaaaaaataaataaaaattgaataggattgtcatcaagaaggcatctttcgctaacgttgcttgtctaggagaaaggtagctatgtaaataaaaacagtgaactagagcaaatagtggtttaatggttttgttattgcatttttaaaatggttaattagggaatttgtagttgttaggaaatgtaaggttgtgtcactgttgattaactgccagaaagactgaatgttctattttcaacatttctcccctataaaagaatagacaaattatactgaagcatgatataaacatcttcccaatgaacaatttgtctcacttgtcagattaactaggttagtgcaggaagcaacatgagcgccaagatgtgttgtctgatttctctaccttaagaacaataatagtctttttagttagtattttggatggccaggtttcaaacctgtatgtggtacaaataatttgggtaatatttttgtatttttgttttacacactctctaatctcaattatcctttgctgggagaatgacaggtttcacttatacaggaaggtttttgcacaggaaatttggtcccagcccttggaaggaagaagttccttcgtttacttagtgaatggagtttctggccgcagatgtgccaagtgattgaagaaagatataccccaatatcaagtgataatttattttcctacagactgaatttgctttatttgaaagatgttgtaactctttttaaagttagattttaccctgaggtatagtatatgtaattttgtgaagattgagctggaagggaagttcacaatcctcacatttaaaaaaatatagtgggtgctaaatgttttcttaaaaatctagtacagcatttgatctttgttatgcacagcatacttttattttacagaataaattttcctgtgatagtcacaacaagacagctgtatagtttcttgagtcttttgtatggaccagtctctgtataatagttaactacaggactgtggatccagcaaatgttcagtaaatgctgctgttgttcttagggaaggctactctgggtgttgtggccgccatacatggctttacctgggtccatgcattcccttaagatgacttctgttttcttcttttttcttctgattttccaaaaaaaaaaagccttgcctaaggttggttttagaatatgatttgcagaacacttttgaaatgtcttcattcatatatgtaatatatatttatacttaaagggccatacgcgatttcaataaaacaagaagtactggaaagaataaacaaaaatagccagaagatgcctagaaaagaacaatgtggaaggagggataaccctattaaatattataacataatgtttacaatatgagaaagtctaggaatttagtacatgataaagcatctcattcagagaaaaaggctttaaaaatggtgttgagagaagtgtggttaaccatttggaaaaaaaaataaaattgaatcgatttctcacaggatacacaggataaaatctgaatagaacaaagacccaatttttaaaatgaaaccctctttctaactagaagaaaacatagatgaattattgtataatctgacagtgagaaaaactttcctaggactgaaaattcagaagcaataaaaagagaagtctatagaagaattttcagccagatggaatggctcatggctgtaatcccagcattttgggaggctgaggcagaaggactgcttgagaccaggaattcaaaaccaacctgggcaacctagtaggactggctctaccaaaaaaaaaaaaaaaaaaaaaattaagtacctggcctgggttccacctacttgggaggctgaggtaggaggactgtgagcccaggagtttgaggatgcagtaagccactgcactccagcctgggtgacagagaagaaaaaagatttttttggatagctgaaaatatttgcagcatttatcacagagggctaattgtagccctatatatgaagaattttaaactatgagaagaacccgaagaataggcaaaaggatgtgaacagacagttaacagaaaatagaatgcaaatggtctttaaacatacaaggatatgcataaaaagacaaatgcaaaataaaataaaataatggaaatacctttcttacctgtgagattggggaaaatccaagttaggcaatgcactctgttgagacaatagggaaacaggcactccaaaaattacaaatccctgtggatggtatttgttaactagcaaagttaaatgagtatatccttcaacctggcagacccagttctaagaatccatatgagatgcacttgcaagaatatgaaatagtatatgcacaaagatcttgattacagcactgtttctaatagctacagactggaagccagccaaatctccattgatagggaattgatggaaggaactagggtatatctatacaatgggatactacacagctgtagaaaggactgcgaactatttttgtagttctggtctggagaaatctccagaatataggaaatgaaaaatgtaaagcacagaagagaatgtatggtgtgctgtctgttgtataacgaagagacaaatggaaaaaatatgtatttgctttttttgtaaagcaatagaagaattagttataccaataactaataaaatgatctccttgttagtggtggtagggagctagacaaggatggcaactatttctgtatcttacataccttttattttgaggccctgtcaatgttttatataataaacattttttgaaaaggcaactcttaaaactaaaacaaacttaacagtctgtcaagttggtgatataaccccacagaagacttacttcaagtgacttgaaaacttagtattttgtctgtactttgctaatggaatatatcctacagaccaaacaaccacaaataaatcttaaactgcattcagtagtttta

SEQ ID NO: 323219 - DNA, 5333 bp, Homo sapiens
agcgggagtgcgcggaagacgcatgcgctggcggcctgcgccgccttaagtgccgcgccagcccggggcggcccagtcggcctgtcagccggcttcgagataagtcccggcgcttgcgcggcggcggctatggcggcggaggaggaggaggtggactctgccgacaccggagagaggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttggtttaagtctagtgcagcgtttaaggcctgatttcaaacgaaagtattcttcaatgttcgaagacgatactgtgacagaatacatctaccactgtaatgtgcagactccaagtggtgagacagctttcaagaatatgactattccttatggatgggcacagtgatctttggcgcccgatcctgcatagatggcaattctggcaccagcatccagtccttacgaccacattcatatgtgaagacaatagctattcttggggcaggacattatgtatatgcagatcaaccagaagaattcaaccagaaagtaaaggagatctgcgacactgtggactgaacacactgaagctctgatgggaaaacctggtgactgatatagttgttcagcaataattcatagtctgtgatgaagagtagtgaatacaacacacaaccaggcagccttcttgactatactttgcacatgttttctttaggaattcactcacacatttaaaccagttagtgccttctagaagaatggctttcctttctcctacacaaaattgaaatatacaagtctctaaatataatacctttaaataaaaggttatttgtccctctgatgtactgaaaaactgtaatttttcagctgaaaattttttaatctaactttgctagttatttttatattgcaatctatattaccaatttaggaagtgatttctgagtctcttacactgtaaaggtgcactttattttctttgtcttccccatcatgtatttattgtgtcttgataactgatattaatctaaattcaatgtgtttttatgtaaaaatttgtcagttgtttagaatatttcactttgtttttgaaacggagtgacaaggcagatttttggttagaggacgggagttgatcactatcattactttttctagtttacctgttttttatatttaaggctgctaagccatgttcagcattttaaatgtggtctatcctgacatacagtgtataacaacataactccttggaacctcctatgtgtggtataattctactcttccaaggaacatgacttcaatactttcagtgattcaggtactgaaaagccttacctaaaaggctgttctttgtttccccctttcatactattcttttccatgacccaggatgcagcaaatgaaacagatttcttctcttaaggggatattaagactgttacttcctagtaagccaagtaataccatatttttattaacatctaacttttgtagatgggtgctaaaattgcatacattttaaccactaaaatagaaaaacaagtggtgctattatgtctcatggcaccagaaatgagctagcacttgggtttgttgttgctgttgtttattaagagtattgtgttaattaaatcattacatacttgaagttatattacaaaaattctagaaggttgattgaactatttttttaggaactaccatcaagtgtagcattttcttgcagttttaaaatgaggaaaacttctttgaaactgtgaaatgctccatgtggtaactggctgctgagaaaacccttcaccaaaaaaataaataaaaattgaataggattgtcatcaagaaggcatctttcgctaacgttgcttgtctaggagaaaggtagctatgtaaataaaaacagtgaactagagcaaatagtggtttaatggttttgttattgcatttttaaaatggttaattagggaatttgtagttgttaggaaatgtaaggttgtgtcactgttgattaactgccagaaagactgaatgttctattttcaacatttctcccctataaaagaatagacaaattatactgaagcatgatataaacatcttcccaatgaacaatttgtctcacttgtcagattaactaggttagtgcaggaagcaacatgagcgccaagatgtgttgtctgatttctctaccttaagaacaataatagtctttttagttagtattttggatggccaggtttcaaacctgtatgtggtacaaataatttgggtaatatttttgtatttttgttttacacactctctaatctcaattatcctttgctgggagaatgacaggtttcacttatacaggaaggtttttgcacaggaaatttggtcccagcccttggaaggaagaagttccttcgtttacttagtgaatggagtttctggccgcagatgtgccaagtgattgaagaaagatataccccaatatcaagtgataatttattttcctacagactgaatttgctttatttgaaagatgttgtaactctttttaaagttagattttaccctgaggtatagtatatgtaattttgtgaagattgagctggaagggaagttcacaatcctcacatttaaaaaaatatagtgggtgctaaatgttttcttaaaaatctagtacagcatttgatctttgttatgcacagcatacttttattttacagaataaattttcctgtgatagtcacaacaagacagctgtatagtttcttgagtcttttgtatggaccagtctctgtataatagttaactacaggactgtggatccagcaaatgttcagtaaatgctgctgttgttcttagggaaggctactctgggtgttgtggccgccatacatggctttacctgggtccatgcattcccttaagatgacttctgttttcttcttttttcttctgattttccaaaaaaaaaaagccttgcctaaggttggttttagaatatgatttgcagaacacttttgaaatgtcttcattcatatatgtaatatatatttatacttaaagggccatacgcgatttcaataaaacaagaagtactggaaagaataaacaaaaatagccagaagatgcctagaaaagaacaatgtggaaggagggataaccctattaaatattataacataatgtttacaatatgagaaagtctaggaatttagtacatgataaagcatctcattcagagaaaaaggctttaaaaatggtgttgagagaagtgtggttaaccatttggaaaaaaaaataaaattgaatcgatttctcacaggatacacaggataaaatctgaatagaacaaagacccaatttttaaaatgaaaccctctttctaactagaagaaaacatagatgaattattgtataatctgacagtgagaaaaactttcctaggactgaaaattcagaagcaataaaaagagaagtctatagaagaattttcagccagatggaatggctcatggctgtaatcccagcattttgggaggctgaggcagaaggactgcttgagaccaggaattcaaaaccaacctgggcaacctagtaggactggctctaccaaaaaaaaaaaaaaaaaaaaaattaagtacctggcctgggttccacctacttgggaggctgaggtaggaggactgtgagcccaggagtttgaggatgcagtaagccactgcactccagcctgggtgacagagaagaaaaaagatttttttggatagctgaaaatatttgcagcatttatcacagagggctaattgtagccctatatatgaagaattttaaactatgagaagaacccgaagaataggcaaaaggatgtgaacagacagttaacagaaaatagaatgcaaatggtctttaaacatacaaggatatgcataaaaagacaaatgcaaaataaaataaaataatggaaatacctttcttacctgtgagattggggaaaatccaagttaggcaatgcactctgttgagacaatagggaaacaggcactccaaaaattacaaatccctgtggatggtatttgttaactagcaaagttaaatgagtatatccttcaacctggcagacccagttctaagaatccatatgagatgcacttgcaagaatatgaaatagtatatgcacaaagatcttgattacagcactgtttctaatagctacagactggaagccagccaaatctccattgatagggaattgatggaaggaactagggtatatctatacaatgggatactacacagctgtagaaaggactgcgaactatttttgtagttctggtctggagaaatctccagaatataggaaatgaaaaatgtaaagcacagaagagaatgtatggtgtgctgtctgttgtataacgaagagacaaatggaaaaaatatgtatttgctttttttgtaaagcaatagaagaattagttataccaataactaataaaatgatctccttgttagtggtggtagggagctagacaaggatggcaactatttctgtatcttacataccttttattttgaggccctgtcaatgttttatataataaacattttttgaaaaggcaactcttaaaactaaaacaaacttaacagtctgtcaagttggtgatataaccccacagaagacttacttcaagtgacttgaaaacttagtattttgtctgtactttgctaatggaatatatcctacagaccaaacaaccacaaataaatcttaaactgcattcagtagtttta

SEQ ID NO: 323220 - DNA, 5287 bp, Homo sapiens
agcgggagtgcgcggaagacgcatgcgctggcggcctgcgccgccttaagtgccgcgccagcccggggcggcccagtcggcctgtcagccggcttcgagataagtcccggcgcttgcgcggcggcggctatggcggcggaggaggaggaggtggactctgccgacaccggagagaggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttggtttaagtctagtgcagcgtttaaggcctgatttcaaacgaaagtattcttcaatgttcgaagacgatactgtgacagaatacatctaccactgtaatgtgcagactccaagcagtgatctttggcgcccgatcctgcatagatggcaattctggcaccagcatccagtccttacgaccacattcatatgtgaagacaatagctattcttggggcaggacattatgtatatgcagatcaaccagaagaattcaaccagaaagtaaaggagatctgcgacactgtggactgaacacactgaagctctgatgggaaaacctggtgactgatatagttgttcagcaataattcatagtctgtgatgaagagtagtgaatacaacacacaaccaggcagccttcttgactatactttgcacatgttttctttaggaattcactcacacatttaaaccagttagtgccttctagaagaatggctttcctttctcctacacaaaattgaaatatacaagtctctaaatataatacctttaaataaaaggttatttgtccctctgatgtactgaaaaactgtaatttttcagctgaaaattttttaatctaactttgctagttatttttatattgcaatctatattaccaatttaggaagtgatttctgagtctcttacactgtaaaggtgcactttattttctttgtcttccccatcatgtatttattgtgtcttgataactgatattaatctaaattcaatgtgtttttatgtaaaaatttgtcagttgtttagaatatttcactttgtttttgaaacggagtgacaaggcagatttttggttagaggacgggagttgatcactatcattactttttctagtttacctgttttttatatttaaggctgctaagccatgttcagcattttaaatgtggtctatcctgacatacagtgtataacaacataactccttggaacctcctatgtgtggtataattctactcttccaaggaacatgacttcaatactttcagtgattcaggtactgaaaagccttacctaaaaggctgttctttgtttccccctttcatactattcttttccatgacccaggatgcagcaaatgaaacagatttcttctcttaaggggatattaagactgttacttcctagtaagccaagtaataccatatttttattaacatctaacttttgtagatgggtgctaaaattgcatacattttaaccactaaaatagaaaaacaagtggtgctattatgtctcatggcaccagaaatgagctagcacttgggtttgttgttgctgttgtttattaagagtattgtgttaattaaatcattacatacttgaagttatattacaaaaattctagaaggttgattgaactatttttttaggaactaccatcaagtgtagcattttcttgcagttttaaaatgaggaaaacttctttgaaactgtgaaatgctccatgtggtaactggctgctgagaaaacccttcaccaaaaaaataaataaaaattgaataggattgtcatcaagaaggcatctttcgctaacgttgcttgtctaggagaaaggtagctatgtaaataaaaacagtgaactagagcaaatagtggtttaatggttttgttattgcatttttaaaatggttaattagggaatttgtagttgttaggaaatgtaaggttgtgtcactgttgattaactgccagaaagactgaatgttctattttcaacatttctcccctataaaagaatagacaaattatactgaagcatgatataaacatcttcccaatgaacaatttgtctcacttgtcagattaactaggttagtgcaggaagcaacatgagcgccaagatgtgttgtctgatttctctaccttaagaacaataatagtctttttagttagtattttggatggccaggtttcaaacctgtatgtggtacaaataatttgggtaatatttttgtatttttgttttacacactctctaatctcaattatcctttgctgggagaatgacaggtttcacttatacaggaaggtttttgcacaggaaatttggtcccagcccttggaaggaagaagttccttcgtttacttagtgaatggagtttctggccgcagatgtgccaagtgattgaagaaagatataccccaatatcaagtgataatttattttcctacagactgaatttgctttatttgaaagatgttgtaactctttttaaagttagattttaccctgaggtatagtatatgtaattttgtgaagattgagctggaagggaagttcacaatcctcacatttaaaaaaatatagtgggtgctaaatgttttcttaaaaatctagtacagcatttgatctttgttatgcacagcatacttttattttacagaataaattttcctgtgatagtcacaacaagacagctgtatagtttcttgagtcttttgtatggaccagtctctgtataatagttaactacaggactgtggatccagcaaatgttcagtaaatgctgctgttgttcttagggaaggctactctgggtgttgtggccgccatacatggctttacctgggtccatgcattcccttaagatgacttctgttttcttcttttttcttctgattttccaaaaaaaaaaagccttgcctaaggttggttttagaatatgatttgcagaacacttttgaaatgtcttcattcatatatgtaatatatatttatacttaaagggccatacgcgatttcaataaaacaagaagtactggaaagaataaacaaaaatagccagaagatgcctagaaaagaacaatgtggaaggagggataaccctattaaatattataacataatgtttacaatatgagaaagtctaggaatttagtacatgataaagcatctcattcagagaaaaaggctttaaaaatggtgttgagagaagtgtggttaaccatttggaaaaaaaaataaaattgaatcgatttctcacaggatacacaggataaaatctgaatagaacaaagacccaatttttaaaatgaaaccctctttctaactagaagaaaacatagatgaattattgtataatctgacagtgagaaaaactttcctaggactgaaaattcagaagcaataaaaagagaagtctatagaagaattttcagccagatggaatggctcatggctgtaatcccagcattttgggaggctgaggcagaaggactgcttgagaccaggaattcaaaaccaacctgggcaacctagtaggactggctctaccaaaaaaaaaaaaaaaaaaaaaattaagtacctggcctgggttccacctacttgggaggctgaggtaggaggactgtgagcccaggagtttgaggatgcagtaagccactgcactccagcctgggtgacagagaagaaaaaagatttttttggatagctgaaaatatttgcagcatttatcacagagggctaattgtagccctatatatgaagaattttaaactatgagaagaacccgaagaataggcaaaaggatgtgaacagacagttaacagaaaatagaatgcaaatggtctttaaacatacaaggatatgcataaaaagacaaatgcaaaataaaataaaataatggaaatacctttcttacctgtgagattggggaaaatccaagttaggcaatgcactctgttgagacaatagggaaacaggcactccaaaaattacaaatccctgtggatggtatttgttaactagcaaagttaaatgagtatatccttcaacctggcagacccagttctaagaatccatatgagatgcacttgcaagaatatgaaatagtatatgcacaaagatcttgattacagcactgtttctaatagctacagactggaagccagccaaatctccattgatagggaattgatggaaggaactagggtatatctatacaatgggatactacacagctgtagaaaggactgcgaactatttttgtagttctggtctggagaaatctccagaatataggaaatgaaaaatgtaaagcacagaagagaatgtatggtgtgctgtctgttgtataacgaagagacaaatggaaaaaatatgtatttgctttttttgtaaagcaatagaagaattagttataccaataactaataaaatgatctccttgttagtggtggtagggagctagacaaggatggcaactatttctgtatcttacataccttttattttgaggccctgtcaatgttttatataataaacattttttgaaaaggcaactcttaaaactaaaacaaacttaacagtctgtcaagttggtgatataaccccacagaagacttacttcaagtgacttgaaaacttagtattttgtctgtactttgctaatggaatatatcctacagaccaaacaaccacaaataaatcttaaactgcattcagtagtttta

SEQ ID NO: 323221 - DNA, 5467 bp, Homo sapiens
agcgggtctgagccggactccggccgcgccgggaggccgccttgaccccgcgcggagggtccgccccgttgttgtataagccaccccgcgggccggcgacggagctggccgcggcggccgcaccggctcgggctctgccaagggacccggcctgccccaatgccgccggcgggcggtgcccggtcgaccctgcacctgactgcgaggcgcgggaaatgaccgggtctgtcagcctcccatcgcggcttccgtctacaggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttggtttaagtctagtgcagcgtttaaggcctgatttcaaacgaaagtattcttcaatgttcgaagacgatactgtgacagaatacatctaccactgtaatgtgcagactccaagtggtgagacagctttcaagaatatgactattccttatggatgggcaaaaaggccaatgctccagcgaattggtaaaatgcaccctgacattccagtttcagtgatctttggcgcccgatcctgcatagatggcaattctggcaccagcatccagtccttacgaccacattcatatgtgaagacaatagctattcttggggcaggacattatgtatatgcagatcaaccagaagaattcaaccagaaagtaaaggagatctgcgacactgtggactgaacacactgaagctctgatgggaaaacctggtgactgatatagttgttcagcaataattcatagtctgtgatgaagagtagtgaatacaacacacaaccaggcagccttcttgactatactttgcacatgttttctttaggaattcactcacacatttaaaccagttagtgccttctagaagaatggctttcctttctcctacacaaaattgaaatatacaagtctctaaatataatacctttaaataaaaggttatttgtccctctgatgtactgaaaaactgtaatttttcagctgaaaattttttaatctaactttgctagttatttttatattgcaatctatattaccaatttaggaagtgatttctgagtctcttacactgtaaaggtgcactttattttctttgtcttccccatcatgtatttattgtgtcttgataactgatattaatctaaattcaatgtgtttttatgtaaaaatttgtcagttgtttagaatatttcactttgtttttgaaacggagtgacaaggcagatttttggttagaggacgggagttgatcactatcattactttttctagtttacctgttttttatatttaaggctgctaagccatgttcagcattttaaatgtggtctatcctgacatacagtgtataacaacataactccttggaacctcctatgtgtggtataattctactcttccaaggaacatgacttcaatactttcagtgattcaggtactgaaaagccttacctaaaaggctgttctttgtttccccctttcatactattcttttccatgacccaggatgcagcaaatgaaacagatttcttctcttaaggggatattaagactgttacttcctagtaagccaagtaataccatatttttattaacatctaacttttgtagatgggtgctaaaattgcatacattttaaccactaaaatagaaaaacaagtggtgctattatgtctcatggcaccagaaatgagctagcacttgggtttgttgttgctgttgtttattaagagtattgtgttaattaaatcattacatacttgaagttatattacaaaaattctagaaggttgattgaactatttttttaggaactaccatcaagtgtagcattttcttgcagttttaaaatgaggaaaacttctttgaaactgtgaaatgctccatgtggtaactggctgctgagaaaacccttcaccaaaaaaataaataaaaattgaataggattgtcatcaagaaggcatctttcgctaacgttgcttgtctaggagaaaggtagctatgtaaataaaaacagtgaactagagcaaatagtggtttaatggttttgttattgcatttttaaaatggttaattagggaatttgtagttgttaggaaatgtaaggttgtgtcactgttgattaactgccagaaagactgaatgttctattttcaacatttctcccctataaaagaatagacaaattatactgaagcatgatataaacatcttcccaatgaacaatttgtctcacttgtcagattaactaggttagtgcaggaagcaacatgagcgccaagatgtgttgtctgatttctctaccttaagaacaataatagtctttttagttagtattttggatggccaggtttcaaacctgtatgtggtacaaataatttgggtaatatttttgtatttttgttttacacactctctaatctcaattatcctttgctgggagaatgacaggtttcacttatacaggaaggtttttgcacaggaaatttggtcccagcccttggaaggaagaagttccttcgtttacttagtgaatggagtttctggccgcagatgtgccaagtgattgaagaaagatataccccaatatcaagtgataatttattttcctacagactgaatttgctttatttgaaagatgttgtaactctttttaaagttagattttaccctgaggtatagtatatgtaattttgtgaagattgagctggaagggaagttcacaatcctcacatttaaaaaaatatagtgggtgctaaatgttttcttaaaaatctagtacagcatttgatctttgttatgcacagcatacttttattttacagaataaattttcctgtgatagtcacaacaagacagctgtatagtttcttgagtcttttgtatggaccagtctctgtataatagttaactacaggactgtggatccagcaaatgttcagtaaatgctgctgttgttcttagggaaggctactctgggtgttgtggccgccatacatggctttacctgggtccatgcattcccttaagatgacttctgttttcttcttttttcttctgattttccaaaaaaaaaaagccttgcctaaggttggttttagaatatgatttgcagaacacttttgaaatgtcttcattcatatatgtaatatatatttatacttaaagggccatacgcgatttcaataaaacaagaagtactggaaagaataaacaaaaatagccagaagatgcctagaaaagaacaatgtggaaggagggataaccctattaaatattataacataatgtttacaatatgagaaagtctaggaatttagtacatgataaagcatctcattcagagaaaaaggctttaaaaatggtgttgagagaagtgtggttaaccatttggaaaaaaaaataaaattgaatcgatttctcacaggatacacaggataaaatctgaatagaacaaagacccaatttttaaaatgaaaccctctttctaactagaagaaaacatagatgaattattgtataatctgacagtgagaaaaactttcctaggactgaaaattcagaagcaataaaaagagaagtctatagaagaattttcagccagatggaatggctcatggctgtaatcccagcattttgggaggctgaggcagaaggactgcttgagaccaggaattcaaaaccaacctgggcaacctagtaggactggctctaccaaaaaaaaaaaaaaaaaaaaaattaagtacctggcctgggttccacctacttgggaggctgaggtaggaggactgtgagcccaggagtttgaggatgcagtaagccactgcactccagcctgggtgacagagaagaaaaaagatttttttggatagctgaaaatatttgcagcatttatcacagagggctaattgtagccctatatatgaagaattttaaactatgagaagaacccgaagaataggcaaaaggatgtgaacagacagttaacagaaaatagaatgcaaatggtctttaaacatacaaggatatgcataaaaagacaaatgcaaaataaaataaaataatggaaatacctttcttacctgtgagattggggaaaatccaagttaggcaatgcactctgttgagacaatagggaaacaggcactccaaaaattacaaatccctgtggatggtatttgttaactagcaaagttaaatgagtatatccttcaacctggcagacccagttctaagaatccatatgagatgcacttgcaagaatatgaaatagtatatgcacaaagatcttgattacagcactgtttctaatagctacagactggaagccagccaaatctccattgatagggaattgatggaaggaactagggtatatctatacaatgggatactacacagctgtagaaaggactgcgaactatttttgtagttctggtctggagaaatctccagaatataggaaatgaaaaatgtaaagcacagaagagaatgtatggtgtgctgtctgttgtataacgaagagacaaatggaaaaaatatgtatttgctttttttgtaaagcaatagaagaattagttataccaataactaataaaatgatctccttgttagtggtggtagggagctagacaaggatggcaactatttctgtatcttacataccttttattttgaggccctgtcaatgttttatataataaacattttttgaaaaggcaactcttaaaactaaaacaaacttaacagtctgtcaagttggtgatataaccccacagaagacttacttcaagtgacttgaaaacttagtattttgtctgtactttgctaatggaatatatcctacagaccaaacaaccacaaataaatcttaaactgcattcagtagtttta

SEQ ID NO: 323222 - DNA, 4580 bp, Homo sapiens
gaaaagctaaatatgaatgtgttttgatagaagtgacagtgcaatgcatactcattcccaaaaatcatacatcgtgattttctccttgccgttaaagtggtgagacagctttcaagaatatgactattccttatggatgggcaaaaaggccaatgctccagcgaattggtaaaatgcaccctgacattccagtttcagtgatctttggcgcccgatcctgcatagatggcaattctggcaccagcatccagtccttacgaccacattcatatgtgaagacaatagctattcttggggcaggacattatgtatatgcagatcaaccagaagaattcaaccagaaagtaaaggagatctgcgacactgtggactgaacacactgaagctctgatgggaaaacctggtgactgatatagttgttcagcaataattcatagtctgtgatgaagagtagtgaatacaacacacaaccaggcagccttcttgactatactttgcacatgttttctttaggaattcactcacacatttaaaccagttagtgccttctagaagaatggctttcctttctcctacacaaaattgaaatatacaagtctctaaatataatacctttaaataaaaggttatttgtccctctgatgtactgaaaaactgtaatttttcagctgaaaattttttaatctaactttgctagttatttttatattgcaatctatattaccaatttaggaagtgatttctgagtctcttacactgtaaaggtgcactttattttctttgtcttccccatcatgtatttattgtgtcttgataactgatattaatctaaattcaatgtgtttttatgtaaaaatttgtcagttgtttagaatatttcactttgtttttgaaacggagtgacaaggcagatttttggttagaggacgggagttgatcactatcattactttttctagtttacctgttttttatatttaaggctgctaagccatgttcagcattttaaatgtggtctatcctgacatacagtgtataacaacataactccttggaacctcctatgtgtggtataattctactcttccaaggaacatgacttcaatactttcagtgattcaggtactgaaaagccttacctaaaaggctgttctttgtttccccctttcatactattcttttccatgacccaggatgcagcaaatgaaacagatttcttctcttaaggggatattaagactgttacttcctagtaagccaagtaataccatatttttattaacatctaacttttgtagatgggtgctaaaattgcatacattttaaccactaaaatagaaaaacaagtggtgctattatgtctcatggcaccagaaatgagctagcacttgggtttgttgttgctgttgtttattaagagtattgtgttaattaaatcattacatacttgaagttatattacaaaaattctagaaggttgattgaactatttttttaggaactaccatcaagtgtagcattttcttgcagttttaaaatgaggaaaacttctttgaaactgtgaaatgctccatgtggtaactggctgctgagaaaacccttcaccaaaaaaataaataaaaattgaataggattgtcatcaagaaggcatctttcgctaacgttgcttgtctaggagaaaggtagctatgtaaataaaaacagtgaactagagcaaatagtggtttaatggttttgttattgcatttttaaaatggttaattagggaatttgtagttgttaggaaatgtaaggttgtgtcactgttgattaactgccagaaagactgaatgttctattttcaacatttctcccctataaaagaatagacaaattatactgaagcatgatataaacatcttcccaatgaacaatttgtctcacttgtcagattaactaggttagtgcaggaagcaacatgagcgccaagatgtgttgtctgatttctctaccttaagaacaataatagtctttttagttagtattttggatggccaggtttcaaacctgtatgtggtacaaataatttgggtaatatttttgtatttttgttttacacactctctaatctcaattatcctttgctgggagaatgacaggtttcacttatacaggaaggtttttgcacaggaaatttggtcccagcccttggaaggaagaagttccttcgtttacttagtgaatggagtttctggccgcagatgtgccaagtgattgaagaaagatataccccaatatcaagtgataatttattttcctacagactgaatttgctttatttgaaagatgttgtaactctttttaaagttagattttaccctgaggtatagtatatgtaattttgtgaagattgagctggaagggaagttcacaatcctcacatttaaaaaaatatagtgggtgctaaatgttttcttaaaaatctagtacagcatttgatctttgttatgcacagcatacttttattttacagaataaattttcctgtgatagtcacaacaagacagctgtatagtttcttgagtcttttgtatggaccagtctctgtataatagttaactacaggactgtggatccagcaaatgttcagtaaatgctgctgttgttcttagggaaggctactctgggtgttgtggccgccatacatggctttacctgggtccatgcattcccttaagatgacttctgttttcttcttttttcttctgattttccaaaaaaaaaaagccttgcctaaggttggttttagaatatgatttgcagaacacttttgaaatgtcttcattcatatatgtaatatatatttatacttaaagggccatacgcgatttcaataaaacaagaagtactggaaagaataaacaaaaatagccagaagatgcctagaaaagaacaatgtggaaggagggataaccctattaaatattataacataatgtttacaatatgagaaagtctaggaatttagtacatgataaagcatctcattcagagaaaaaggctttaaaaatggtgttgagagaagtgtggttaaccatttggaaaaaaaaataaaattgaatcgatttctcacaggatacacaggataaaatctgaatagaacaaagacccaatttttaaaatgaaaccctctttctaactagaagaaaacatagatgaattattgtataatctgacagtgagaaaaactttcctaggactgaaaattcagaagcaataaaaagagaagtctatagaagaattttcagccagatggaatggctcatggctgtaatcccagcattttgggaggctgaggcagaaggactgcttgagaccaggaattcaaaaccaacctgggcaacctagtaggactggctctaccaaaaaaaaaaaaaaaaaaaaaattaagtacctggcctgggttccacctacttgggaggctgaggtaggaggactgtgagcccaggagtttgaggatgcagtaagccactgcactccagcctgggtgacagagaagaaaaaagatttttttggatagctgaaaatatttgcagcatttatcacagagggctaattgtagccctatatatgaagaattttaaactatgagaagaacccgaagaataggcaaaaggatgtgaacagacagttaacagaaaatagaatgcaaatggtctttaaacatacaaggatatgcataaaaagacaaatgcaaaataaaataaaataatggaaatacctttcttacctgtgagattggggaaaatccaagttaggcaatgcactctgttgagacaatagggaaacaggcactccaaaaattacaaatccctgtggatggtatttgttaactagcaaagttaaatgagtatatccttcaacctggcagacccagttctaagaatccatatgagatgcacttgcaagaatatgaaatagtatatgcacaaagatcttgattacagcactgtttctaatagctacagactggaagccagccaaatctccattgatagggaattgatggaaggaactagggtatatctatacaatgggatactacacagctgtagaaaggactgcgaactatttttgtagttctggtctggagaaatctccagaatataggaaatgaaaaatgtaaagcacagaagagaatgtatggtgtgctgtctgttgtataacgaagagacaaatggaaaaaatatgtatttgctttttttgtaaagcaatagaagaattagttataccaataactaataaaatgatctccttgttagtggtggtagggagctagacaaggatggcaactatttctgtatcttacataccttttattttgaggccctgtcaatgttttatataataaacattttttgaaaaggcaactcttaaaactaaaacaaacttaacagtctgtcaagttggtgatataaccccacagaagacttacttcaagtgacttgaaaacttagtattttgtctgtactttgctaatggaatatatcctacagaccaaacaaccacaaataaatcttaaactgcattcagtagtttta

SEQ ID NO: 323223 - DNA, 1447 bp, Homo sapiens
agcgggagtgcgcggaagacgcatgcgctggcggcctgcgccgccttaagtgccgcgccagcccggggcggcccagtcggcctgtcagccggcttcgagataagtcccggcgcttgcgcggcggcggctatggcggcggaggaggaggaggtggactctgccgacaccggagagaggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttggtttaagtctagtgcagcgtttaaggcctgatttcaaacgaaagtattcttcaatgttcgaagacgatactgtgacagaatacatctaccactgtaatgtgcagactccaagtggtgagacagctttcaagaatatgactattccttatggatgggcaaaaaggccaatgctccagcgaattggtaaaatgcaccctgacattccagtttcagtgatctttggcgcccgatcctgcatagatggcaattctggcaccagcatccagtccttacgaccacattcatatgtgaagacaatagctattcttggggcaggacattatgtatatgcagatcaaccagaagaattcaaccagaaagtaaaggagatctgcgacactgtggactgaacacactgaagctctgatgggaaaacctggtgactgatatagttgttcagcaataattcatagtctgtgatgaagagtagtgaatacaacacacaaccaggcagccttcttgactatactttgcacatgttttctttaggaattcactcacacatttaaaccagttagtgccttctagaagaatggctttcctttctcctacacaaaattgaaatatacaagtctctaaatataatacctttaaataaaaggttatttgtccctctga

SEQ ID NO: 323224 - DNA, 1661 bp, Homo sapiens
tgattgcatttagactattcatttagactacctacttcataaacagccccaaatcgcgatcccgatataaaccatttaggtctaaatgcaatcatgattgcatttagaccagagaaaaaggctttaaaaatggtgttgagagaagtgtggttaaccatttggaaaaaaaaataaaattgaatcgatttctcacaggatacacaggataaaatctgaatagaacaaagacccaatttttaaaatgaaaccctctttctaactagaagaaaacatagatgaattattgtataatctgacagtgagaaaaactttcctaggactgaaaattcagaagcaataaaaagagaagtctatagaagaattttcagccagatggaatggctcatggctgtaatcccagcattttgggaggctgaggcagaaggactgcttgagaccaggaattcaaaaccaacctgggcaacctagtaggactggctctaccaaaaaaaaaaaaaaaaaaaaaattaagtacctggcctgggttccacctacttgggaggctgaggtaggaggactgtgagcccaggagtttgaggatgcagtaagccactgcactccagcctgggtgacagagaagaaaaaagatttttttggatagctgaaaatatttgcagcatttatcacagagggctaattgtagccctatatatgaagaattttaaactatgagaagaacccgaagaataggcaaaaggatgtgaacagacagttaacagaaaatagaatgcaaatggtctttaaacatacaaggatatgcataaaaagacaaatgcaaaataaaataaaataatggaaatacctttcttacctgtgagattggggaaaatccaagttaggcaatgcactctgttgagacaatagggaaacaggcactccaaaaattacaaatccctgtggatggtatttgttaactagcaaagttaaatgagtatatccttcaacctggcagacccagttctaagaatccatatgagatgcacttgcaagaatatgaaatagtatatgcacaaagatcttgattacagcactgtttctaatagctacagactggaagccagccaaatctccattgatagggaattgatggaaggaactagggtatatctatacaatgggatactacacagctgtagaaaggactgcgaactatttttgtagttctggtctggagaaatctccagaatataggaaatgaaaaatgtaaagcacagaagagaatgtatggtgtgctgtctgttgtataacgaagagacaaatggaaaaaatatgtatttgctttttttgtaaagcaatagaagaattagttataccaataactaataaaatgatctccttgttagtggtggtagggagctagacaaggatggcaactatttctgtatcttacataccttttattttgaggccctgtcaatgttttatataataaacattttttgaaaaggcaactcttaaaactaaaacaaacttaacagtctgtcaagttggtgatataaccccacagaagacttacttcaagtgacttgaaaacttagtattttgtctgtactttgctaatggaatatatcctacagaccaaacaaccacaaataaatcttaaactgcattcagtagtttta

SEQ ID NO: 323225 - DNA, 915 bp, Homo sapiens
agcgggagtgcgcggaagacgcatgcgctggcggcctgcgccgccttaagtgccgcgccagcccggggcggcccagtcggcctgtcagccggcttcgagataagtcccggcgcttgcgcggcggcggctatggcggcggaggaggaggaggtggactctgccgacaccggagagaggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaaggtaagtggtggtgacagaagagagggattataactgtgcttccaagtaccagactctagttcccatctttggtggttgttagtgtctgagccacaaggcagacattctcttaaaggaccctatagaccacaccacaactgatgaccaatatagtagctgaaataatcatgtcagatcttcctattacacgtactacatgttaataggcttgggaaaggggtttctatttgttaagcttagaattgtagaaactttaatgtataattttaagccacaagta

SEQ ID NO: 323226 - DNA, 844 bp, Homo sapiens
aaatttaatttcatttttaggcaatttttgggagtgtttaaagtatttagttccacaacattaaaggtaaaaaagagttttggtctataaaattgtgactatttgctttttctaggagattactagagttggacccaagttacctggtgtgtcatgctgaggagttcctacaatactttgtcaacctttttttgaaatgacttaaggtttcacttacatgtttaacatagataccagtaatccttccctaaattcatgactactttttaaggaaaaatgatgcctttaagcctgacttcaactcaaagttaaccaaagaataccaccttgaaattgtagaacacctgacagtattctacaaattctctgcaaagctagagaccttaaaataatgggttcggtaaccactaagttccttttcacttctaggagtataataccctcatttgacagatgtggaaagaagttagaaggtaatatgacttgccaaagaccttgatcacaggttacttgaggtttgtctgaggtaggtcttcccctttaggtgtaaaacatggtcatttaggattatttacttcaataaaatgtgtactttttaaaaatagctgacaatacaagctaaaatcatgagattggatactagatgatttgtaatttttggttgctctgagaatacttcccttctcagaagtaataaaatgaaacagaatttctcttttatgttttcattaggtgtgccttgcacatacaaaaaagaacctgttcgtatatctaatggaaataaaatatggacactgaagttctctcataatatttcaaataagactccacttgtccttctcca

SEQ ID NO: 323227 - DNA, 1349 bp, Homo sapiens
agcgggagtgcgcggaagacgcatgcgctggcggcctgcgccgccttaagtgccgcgccagcccggggcggcccagtcggcctgtcagccggcttcgagataagtcccggcgcttgcgcggcggcggctatggcggcggaggaggaggaggtggactctgccgacaccggagagaggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttggtttaagtctagtgcagcgtttaaggcctgatttcaaacgaaagtattcttcaatgttcgaagacgatactgtgacagaatacatctaccactgtaatgtgcagactccaagcagtgatctttggcgcccgatcctgcatagatggcaattctggcaccagcatccagtccttacgaccacattcatatgtgaagacaatagctattcttggggcaggacattatgtatatgcagatcaaccagaagaattcaaccagaaagtaaaggagatctgcgacactgtggactgaacacactgaagctctgatgggaaaacctggtgactgatatagttgttcagcaataattcatagtctgtgatgaagagtagtgaatacaacacacaaccaggcagccttcttgactatactttgcacatgttttctttaggaattcactcacacatttaaaccagttagtgccttctagaagaatggctttcctttctcctacacaaaattgaaatatacaagtctctaaatataatacctttaaataaaaggttatttgtccctctga

SEQ ID NO: 323228 - DNA, 2192 bp, Homo sapiens
gaattccggttctcactcttgacgttgtccagctccagcaccttggcaactcccccagcttggacggccggcccgccgctccatgggggagtcatctgagctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctacatccttaaaagccatggagccggaggtggcaattcaccgaattc

SEQ ID NO: 323229 - DNA, 994 bp, Homo sapiens
aataggctaggtacgaggctgggtttgaatcggccgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagagtaatgggtgcagtccgagtccgaaggtgggctggtccagaagactgtctgctcgactgtagattggggcggggggggctccaggtgagtgggctccggggggatgtttgccctccgcggggggcccacgttgtggcgctggtcctggagagccgcggggg

SEQ ID NO: 323230 - DNA, 533 bp, Homo sapiens
  misc_feature (16)..(16): n is a, c, g, or t
  misc_feature (23)..(23): n is a, c, g, or t
  misc_feature (25)..(26): n is a, c, g, or t
  misc_feature (37)..(37): n is a, c, g, or t
  misc_feature (44)..(44): n is a, c, g, or t
  misc_feature (49)..(50): n is a, c, g, or t
  misc_feature (63)..(63): n is a, c, g, or t
  misc_feature (74)..(74): n is a, c, g, or t
gctgactgagctgtcntgtcagntnntgtatataccntcctcgntgcannatccaacgtcttnaagatccgcgnggcaaagtacgggccggcgttttaccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggcgtctgtccggacagacgccacgtccaccgactgaccggcattgcgcccggtaccagcgttcgataggtcgccggtacggatggcggatggcgcagaaccggcgatcccattcatcgccggcgcaacagattcggcatccagccgatgccttgtgcatgcaggctctggatgtataaccgctccggcgtatcggtcacgccggtggtttccggatatttgccgccgggtcctgcggtcccgtgtata

SEQ ID NO: 323231 - DNA, 2466 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagtaaaaaaaaaaaaaaagaaagaaaaacaaaaaaaaggggggggggagaaaaaagaatcaccaagagagggggcaaattacagggcaaaccacttttgtggaaaaaaggggaccatatagagagaaggaagaaa

SEQ ID NO: 323232 - DNA, 2263 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctaccaaaccggccagtcacgagagaattagcatccggtacaggacccgcggggaaggaaacctcccaataaattaaacccggacccaaaaagggaaaagggcggcgcatatcacctctcccctcgc

SEQ ID NO: 323233 - DNA, 2276 bp, Homo sapiens
ggctaggagaggccgtgggtgaatcggccgaggctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323234 - DNA, 2324 bp, Homo sapiens
aaacagcaacaacacgcacaacacccgtcgaagcattatcatggtcggtcctggtttattcggtcgaggagtgctttcgtgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323235 - DNA, 2279 bp, Homo sapiens
aataggctaggtacgaggctgggtttgaatcggccgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323236 - DNA, 2491 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactggtaagacctagaaagcacggagccctagcaggagggtggactttgaggacaggcactgggcctgtgggcagcagcttctgggagggggaggtaccttggcattgtgggcagagagagggctctggttctgattcttgcctgttcctgttttcctagttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323237 - DNA, 1963 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcacggttcctcctctccccagcctgggaagatgtctcactgtccacctcccccatttacttctccacctcccgtcctccccatcattggtttttttttgtgtgtcaactgtgccgtttttattttattccttttattttcccccttttcacagagaaataaaggtctagaagta

SEQ ID NO: 323238 - DNA, 1842 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323239 - DNA, 1680 bp, Homo sapiens
  misc_feature (1518)..(1518): n is a, c, g, or t
  misc_feature (1529)..(1529): n is a, c, g, or t
  misc_feature (1539)..(1539): n is a, c, g, or t
  misc_feature (1554)..(1554): n is a, c, g, or t
  misc_feature (1566)..(1566): n is a, c, g, or t
  misc_feature (1580)..(1580): n is a, c, g, or t
  misc_feature (1582)..(1583): n is a, c, g, or t
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtttatgccatcgggaggaggcaccgancctgaagactntggaattggngggtgggcctccaantcccaggttgcngtcgggaccactgncnngatacttgcaagggtggcgggcgggaacccccaagtccggtgggtgggccgcccgctcttctctaacactcgccctcgtggccagcacagcggtacc

SEQ ID NO: 323240 - DNA, 2456 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggtgagttttgcttcctggccctctgctctcccgtccttctggtggttcctgcccatgaaagagaatcccagagctcagcaaggcctctgctgccctcccactgttcctctcctctccctaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323241 - DNA, 2460 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagtgctgggagctattaataataggagaggcctcgtggtgatgaagaaatgaggggagagtttcacagtctgtcctgccatcagagcagctggctttggatcccacactccctcggtgcttgctttgcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323242 - DNA, 2002 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323243 - DNA, 1523 bp, Homo sapiens
gcgtcgacggaccaggtctgtcttggtgatctcaggccccactgctttctggagctctgtgaacttgtcagccaccatgtagcggacgcgccaggacttgtcttcagcggcctggcgcagagtgggcatcaccagggcctccagatcctcctggggcagaagctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323244 - DNA, 973 bp, Homo sapiens
  misc_feature (891)..(891): n is a, c, g, or t
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagagngaaacaggatgcgggcggtaaggggcagccagccaaacacaagaaggagagaaacaacaccgggcggacaaagaaacggcca

SEQ ID NO: 323245 - DNA, 1050 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagagtaatgggtgcagtccgagtccgaaggtgggctggtccagaagactgtctgctcgactgtagattggggcggggggggctccaggtgagtgggctccggggggatgtttgccctccgcggggggcccacgttgtggcgctggtcctggagagccgcggggg

SEQ ID NO: 323246 - DNA, 1188 bp, Homo sapiens
aaataaatcagggatcggaaaaaccacaaaaccccggattccccctgccgggcaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323247 - DNA, 1183 bp, Homo sapiens
  misc_feature (797)..(797): n is a, c, g, or t
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggtgtggngtggaagcgtggtgaacatcgccaagttaggcccaagaggaccgggaggaccaggaaatggcacactggccaagcagatgagaaaagtctgggagcggccgaacactggagtgtgtacaagaccaagagacccagaaagacacgagggccgtgaaatcaccaaagaaaaaccagagcccggaccacagcaacggtaatagaacggtagcgcaccacgtagtacgccacgcccaccagagagaaggaacggtggacacacacacgaatgaacaagattacacacaaaaagccaactagcaaggagacacgacacacaaagctaggtaggatacagcagatgcacatgcacagagacgacacagcaacaacagcagagagatagaaaa

SEQ ID NO: 323248 - DNA, 570 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagagacggggtttcaccatgttggccaggcttggtcgggaactcttgacctcaagcgatccacccgcctcggcctcccaaagtgttggaattacaggcgtgagccaccgcgcccagcccggatgaacattcctggttatgggatgaggtgacccaaggctctgagccgggctggtgtgggattgagaacagttagaactgcaagtccacctcccacctgctgtgtgaccttgtgcaaattacttcaccgctttgggtctctgtgttccataaaatatgggctaattgtagtcctggtcttgctggagggacttgtgagggactgaacgaattatgacacaaataaaaagtagaatggtgtcaggcc

SEQ ID NO: 323249 - DNA, 527 bp, Homo sapiens
cccacgccactctctggagagcattgctttaaggagggatcctagggcttggtaattaaggtcgatctccagaataattaagggaagcctgaggacagagaaactgggacatggtgttaggatggtgttagtggagttgggagattcactccactaactgagtcacccgtattgctcagcctctgtggggcctgatgatcaccagagtggcctggtcagaggcagcaggaaatgagagttagccaggagctttgcatactcacccctgccactcactggcccccaggtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagggtgaggtctggatactcccccacacactggcaggggcttcttgtgggcaccttaatctttgacctttgaaggtagagcccagggtcagaggcctggc

SEQ ID NO: 323250 - DNA, 650 bp, Homo sapiens
caactcaacgaggacatcattgtctcatcttgctggctcatttcccggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgagtcggcccatccgagcagtgtaaggatccgctagagtacctcagcacac

SEQ ID NO: 323251 - DNA, 2335 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323252 - DNA, 2304 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323253 - DNA, 2276 bp, Homo sapiens
  misc_feature (1)..(1): n is a, c, g, or t
  misc_feature (31)..(33): n is a, c, g, or t
naaccaatacggtaggtacgaggctgggtgnnnctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323254 - DNA, 2343 bp, Homo sapiens
gaattccggttctcactcttgacgttgtccagctccagcaccttggcaactcccccagcttggacggccggcccgccgctccatgggggagtcatctgagctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323255 - DNA, 2281 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggtgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323256 - DNA, 1853 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgagtcggcccatccgagcagtgtaaggatccgctagagtacctcagcacac

SEQ ID NO: 323257 - DNA, 1807 bp, Homo sapiens
  misc_feature (1682)..(1682): n is a, c, g, or t
  misc_feature (1687)..(1687): n is a, c, g, or t
  misc_feature (1751)..(1751): n is a, c, g, or t
  misc_feature (1769)..(1769): n is a, c, g, or t
  misc_feature (1777)..(1777): n is a, c, g, or t
  misc_feature (1799)..(1799): n is a, c, g, or t
  misc_feature (1804)..(1804): n is a, c, g, or t
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgttctgtctgaagtctgttggggcaggacatcaccncccangccacattgcttaccccaccggttcctgccccattggcttgggggaaccccggtttgcccaatnttccccttccaattgttnggccaaanttctcctgccaaaaaaaaatanggggnccc

SEQ ID NO: 323258 - DNA, 1616 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatgtgccatccgcgaggcagccattaaaaagacggccagtcgtatgggcggccgagggaagatgcgggggaaagtgcagccaagcctcgcgatgttgcccatgcacggagagcgattaaccagc

SEQ ID NO: 323259 - DNA, 2158 bp, Homo sapiens
aacagagtggtcctggaaagtgcaactgacttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323260 - DNA, 1944 bp, Homo sapiens
tattatgcgcaatctgcgaagtgtctcacacacactattttcatttaaacctcatgcggacctgtggggtaggtactgttactatcagctccgtttcatagggctgggaagacagagagggggtcatcacttgcccaaggtcattcagctaaaacctggacccacacaactgcagagtctgtgcttgctcctctctgccatactgcctgctgcctcaggatccccgtccccgactcccaggtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagacaagtcctggcgcgtccgctacatggtggctgacaagttcacagagctccagaaagcagtggggcctgagatcaccaagacagacctggtccctgccttccagaacctgatgaaagactgtgaggccgaggtgagggccgcagcctcccacaaggtcaaagagttctgtgaaaacctctcagctgactgtcgggagaatgtgatcatgtcccagatcttgccctgcatcaaggagctggtgtccgatgccaaccaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323261 - DNA, 1082 bp, Homo sapiens
  misc_feature (891)..(891): n is a, c, g, or t
  misc_feature (906)..(906): n is a, c, g, or t
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtacttccggaacctgtgctcagatgacacccccatggtgcggcgggccgcagcctccaagctgggggagtttgccaaggtgctggagctggacaacgtcaagagtgagatcatccccatgttctccaacctggcctctgacgagcaggactcggtgcggctgctggcggtggaggcgtgcgtgaacatcgcccagcttctgccccaggaggatctggaggccctggtgatgcccactctgcgccaggccgctgaagagngggaaaaaagcgggngcccaaaggggcgcaacgtcacaacccaaagacgggggcgggaacccgaagacgggccgcccccagctggagacgcggcgcggggcgcgccccaggaaagggaacaacaccgcgggagacagccgccccgcagagcgcggccacaaacaacgccctggtcgctcgcaacaacacca

SEQ ID NO: 323262 - DNA, 1229 bp, Homo sapiens
aataggctaggtacgaggctgggtttgaatcggccgcaacatgtcaagtctgccctggcctcagtcatcatgggtctctctcccatcttgggcaaagacaacaccatcgagcacctcttgcccctcttcctggctcagctgaaggatgagtgccctgaggtacggctgaacatcatctctaacctggactgtgtgaacgaggtgattggcatccggcagctgtcccagtccctgctccctgccattgtggagctggctgaggacgccaagtggcgggtgcggctggccatcattgagtacatgcccctcctggctggacagctgggagtggagttctttgatgagaaacttaactccttgtgcatggcctggcttgtggatcatgtatatgccatccgcgaggcagccaccagcaacctgaagaagctagtggaaaagtttgggaaggagtgggcccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323263 - DNA, 872 bp, Homo sapiens
  misc_feature (16)..(16): n is a, c, g, or t
  misc_feature (23)..(23): n is a, c, g, or t
  misc_feature (25)..(26): n is a, c, g, or t
  misc_feature (37)..(37): n is a, c, g, or t
  misc_feature (44)..(44): n is a, c, g, or t
  misc_feature (49)..(50): n is a, c, g, or t
  misc_feature (63)..(63): n is a, c, g, or t
  misc_feature (74)..(74): n is a, c, g, or t
gctgactgagctgtcntgtcagntnntgtatataccntcctcgntgcannatccaacgtcttnaagatccgcgnggcaaagtacgggccggcgttttaccatgccacaatcatccccaaggtcttggccatgtccggagaccccaactacctgcaccgcatgactacgctcttctgcatcaatgtgctgtctgaggtctgtgggcaggacatcaccaccaagcacatgctacccacggttctgcgcatggctggggacccggttgccaatgtccgcttcaatgtggccaagtctctgcagaagatagggcccatcctggacaacagcaccttgcagagtgaagtcaagcccatcctagagaagctgacccaggaccaggatgtggacgtcaaatactttgcccaggaggctctgactgttctgtctctcgcctgatgctggaagaggagcaaacactggcctctggtgtccaccctccaacccccacaagtccctctttggggagacactggggggcctttggctgtcactccctgtgcatggtctgaccccaggccccttcccccagcacggttcctcctctccccagcctgggaagatgtctcactgtccacctcccaacgggctaggggagcacggggttggacaggacagtgaccttgggaggaaggggctactccgcccacgtcagggagagatgtgagcatcccgggtcactggatcctgctgctgtaatgggaacccctcccccatttacttctccacctcccgtcctccccatcattggtttttttttgtgtgtcaactgtgccgtttttattttattccttttattttcccccttttcacagagaaataaaggtctagaagta

SEQ ID NO: 323264 - DNA, 1406 bp, Homo sapiens
gtggagcagcccctgtaaactggctcgggcgcccccacgcccgcccttccttcttctcccagcattgcccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgccgctagtgaagcggctggcgggcggcgactggttcacctcccgcacctcggcctgcggcctcttctccgtctgctacccccgagtgtccagtgctgtgaaggcggaacttcgacagtgagtctctgcctccttggaagctccaagctcccatctcagctccaaccttctctaaagcctcagactccttttggtctagctggggcccaaatgcccctgaactctctccactcccactcctgcttaccacctgataggccacatcctcgagagttggtctctggacacggccacgtgtcagtttacccacctctgcccccttgctcacttaggaattgagatgatgacaggtcctccttcccactggttaatgtgaggatttaaaagaattatcacacataaagtgcttagagcaaaatctggaacataaaaactttcagcaacttacatctgatggtatctccagcctgtcccaggtccagtgcctttggcagataaaccacctcagttttcagcctcctgctcgtctactttgcaaacgattgaccgtcaagcccgggtttgagcctgactcactccagaactctggtttatggctgtacacttgcttagatacttacactggcccccaccgcctttgatcgaagcaattgctgctgaaaaataaagcctttctgtggctctagacctgcctcttagttaagcagttttttgtttgtttgttttttgagataggatctcgctctgtcatccaggctgaagtgcactggtgcagtcatagcccactgcagcctcaacctcctgggctcaagcattcctcctgccttagcctctcaaatagctgggaccacaggtgtgcaacaccacgctgggctcattttttatttttggc

SEQ ID NO: 323265 - DNA, 395 bp, Homo sapiens
ggtggcttagctgtggtcctcactttccccacctagggcctagagacaggagcagggctaagcccactggatttttaaatgtatagctgaacgtcacttgaatcagagcctcatcaatgtctagcactttttgctgttgtttctaccccttgagggagtgtatttaccctgcccccagtcctctgtattcaacagaatacaattcttgtatatgaagacaacacgggcttaccatgacaagcctagaagaggtcctaatgaacaggtgccctgctatctactcaggctacgaaagaaaagactagagattcctccaaactacagactcgattcatgggagatgctctccacctctaactggtttccaagaatccaccatagtgggccatcttgtt

SEQ ID NO: 323266 - DNA, 738 bp, Homo sapiens
aatcaaattccctcaggattggttgctggacaattccactaacacttacaatgggacaaggggaaccaggagacccctcaagtggatcactgggttccacacacattcctcctgccctcattgtgacagcagcccaacctcctcctggagattaggatctattacctgtgcctggagaggaggggactcctcacttgctggtctctgggcacatactgtccaaatctctctgggggcaatagtaatgtgttcttcagtaggctctcatttgtcctgatttaagagtaccttcctttagaatccaggaccttctaccctgcagagcacaggtttgggagatgagaagtgcaaaatcccacagcaggtgaatctaaggaatgagacatggagccatacccactttcactccttagtttctggacccacatgttcttcctactgagaacacggcactgtagagatgtctctgatttaataaatgcaccatgtcccgaaagacagcacccacccctcagagtgcttcctccaggctggcactgagttgtgcctgtagaagacctgtccagcattcttagtggctggcagaccctgggtggtgcagatggtgatagaaccagtggatcccatggccatgaaaatgctgcacctgcttccctgtcaagtgggttccaccaggaagacagtgtgctaagagcaatgccatgcctgtgaatcaggaatgtcaacagtccctggaga

SEQ ID NO: 323267 - DNA, 251 bp, Homo sapiens
cctttcccctggcttacagtaggggctcaatcagtgtatgtggattgaatgaatgaaagttctctctagttcattgtatgggactagctgatggcgttagagacaccctccgccccatatgtccaaagtggcttcagatctgccccggaggaacccccactctgggaaaacagagctggaccaacagctgctgtggtgtcagggctgggataaatggaaggacaggaatggggtgtcccagagggctctct

SEQ ID NO: 323268 - DNA, 286 bp, Homo sapiens
aaaaaaacaaaacagcattctcagagtaaaaatattagacctggaagcaaccttagaaatcatcatgctttagcagtggattttagaaataggaaactttttattaggtgagatgatttgcctgggattatgcagtagcaaaagcatttaagaatctggatttctgcctcagtctcagaatttcttgttacatgggtatattttatttttatttttatttatttatttatttatttatttatttgagatggagttttgctcttgttgcttaagctggagtgcaatg

SEQ ID NO: 323269 - DNA, 890 bp, Homo sapiens
cccgccacgacgtccggctaatttttgtatttttagtagagacgaggtttcaccgtgttagccaggatggtctccatctcctgacctcgtgatccaccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaaaatgacaaatcttattaaaatatgtgcaatatttatggaagtcaaacagcttcatatcagtgataaagattgttattaaaagataaatactgtctgttaatttaca

SEQ ID NO: 323270 - DNA, 687 bp, Homo sapiens
aataatcagaagtggttttcatttgggcatttggttttgcaactgttcttgtcctgtcatgccagtgtacctttttctttgaagcggtgacctttttgtaattatttggtcaaaaaccaagtcaaggtggatgctgtcttaactatgcctagactaattatgttgcattaattatacctgggttatttgccttgcagcatgtgcctaagcctggacacaagagaacagactccacccacagcagcaacgagtctgaatatatctttagctctgaaattgcagaaatggaagacattccatcaaggacagaggtacagtttagacatctgtcactgaaagtaggatatgagcatgctgttgttaacaaggaacatttccattgcaaagcagactccaattggccataaacatagtatttgtttgaatcatttattcttcataagtgacttgtagatacaaacttatttacatttttgtatacttaagtgctgtgtacatacatacctattgcatttttttgtcaatacaaattttaattttaatttttaatgcaattttgatggtgagattttatttttataattctctttacccctaacatgatatgtttacaggaatttatttcagactgaggtaaattattttatttttacttattatttatttactttatatctgtggaccacc

SEQ ID NO: 323271 - DNA, 7755 bp, Homo sapiens
aatacaccccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggccggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgacctcatgggtgtggactatgaggagatgtgtcactggctctgccatcggaaactggctactgccacagagacatacatcaagcccatctccaagctgcaggccacgaatgcccgcgatgctttggccaaacacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactattgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaaaatgacaaatcttattaaaatatgtgcaatatttatggaagtcaaacagcttcatatcagtgataaagattgttattaaaagataaatactgtctgttaatttaca

SEQ ID NO: 323272 - DNA, 7674 bp, Homo sapiens
aatacaccccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggccggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgacctcatgggtgtggactatgaggagatgtgtcactggctctgccatcggaaactggctactgccacagagacatacatcaagcccatctccaagctgcaggccacgaatgcccgcgatgctttggccaaacacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactattgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaaaatgacaaatcttattaaaatatgtgcaatatttatggaagtcaaacagcttcatatcagtgataaagattgttattaaaagataaatactgtctgttaatttaca

SEQ ID NO: 323273 - DNA, 6996 bp, Homo sapiens
aggacctgtgttctactccatcttttctctctctgagcagattctgtaaatgtcatgttatgaattacacttctaaaatcttattttctcccttgctttttagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgacctcatgggtgtggactatgaggagatgtgtcactggctctgccatcggaaactggctactgccacagagacatacatcaagcccatctccaagctgcaggccacgaatgcccgcgatgctttggccaaacacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactattgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaaaatgacaaatcttattaaaatatgtgcaatatttatggaagtcaaacagcttcatatcagtgataaagattgttattaaaagataaatactgtctgttaatttaca

SEQ ID NO: 323274 - DNA, 7658 bp, Homo sapiens
aatacaccccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggccggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgacctcatgggtgtggactatgaggagatgtgtcactggctctgccatcggaaactggctactgccacagagacatacatcaagcccatctccaagctgcaggccacgaatgcccgcgatgctttggccaaacacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactattgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagtagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaaaatgacaaatcttattaaaatatgtgcaatatttatggaagtcaaacagcttcatatcagtgataaagattgttattaaaagataaatactgtctgttaatttaca

SEQ ID NO: 323275 - DNA, 1002 bp, Homo sapiens
aatacaccccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggccggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggaggtaagacagcgagtcttcggctttcttcctatattctcttgataagaaacatgctcaaaaaattgattgatacagcatgtctcagaaagcctggggtctccagccactaaaattaagaaaatgcttttctacatgtttat

SEQ ID NO: 323276 - DNA, 206 bp, Homo sapiens
caattctacttgatgtcagacttccttaatttgcaaagcagggctcctggcagaacctaggaagccattcactagggtaactctgatgaactttttcagcagaattcttctaccagcttgggagaagtttgagcatccaacgtaaagttgaggatgacagcaatgaacttttctttgtcttttcatacagcgtcaagaactagaat

SEQ ID NO: 323277 - DNA, 117 bp, Homo sapiens
cttttaattttccagattataggtacccagtgtgtatttgataatatgccaaaaactttgatcatttcatttctcacagattgtgaaagtgttgaatttgtatactccagttaatga

SEQ ID NO: 323278 - DNA, 286 bp, Homo sapiens
ggataatgtgttatcttttattatcttattttacaatgcactaacttttttgataatagttaattgggaaaatgaagtgagtttaaaacaaaagtaaacattcttcattagttgagaatttgagggtagaaattttagtagaaaaaagtcttttagattcaaagaactgatgctctgtttattttttttcctaatcttctcagatgcgtttacgagacaggaaagactctccccagctgctcatggatgctaaacacatctttcctgtcacctttcctttcaaccc

SEQ ID NO: 323279 - DNA, 461 bp, Homo sapiens
atcttattttatgatagaattccctgaattttagattaaaatgctgtaattgaaaactcttcttatttcgaaggcagaagaggagagaaactatcatatcttctatcagctttgtgcctcagcaaagttacctgaatttaaaatgctacgattaggtatgaatatggcattaaatttattgttctggtattgttttctgttaatttccaagttcctaaatttacttgttaaaaaggagcttatctcatgttggaatacttatggataatatgataaaaagtcagcccttggcttcaaaataacccataggggtagaggaggagtaagtggctgtataaatggaacaggattggcctggaggtgatttagatggctgtttaagatgagtaatgagtacctaggggctcattctattagtctctctacttttgtatgtgtttgatatttgctttgattaaagg

SEQ ID NO: 323280 - DNA, 481 bp, Homo sapiens
gttggtatgtctaatgaaaacgcacttcatattgtttccatctccaccagtttctgtgatattggaaggtgctaggaaaataatgcatttaatagctgagaagcaaatcaggaataggaagtaagcaaaatgcatgggcctctttcacagtccttgccataattcatccagatgctgtgccttgtgcattttcaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtaagtatgctttgctttccgaatagactgtggactctttcctctaatggacatagccatagaaatattgtacatggggaaagcaggctgtggttggattttctctaagagaca

SEQ ID NO: 323281 - DNA, 7680 bp, Homo sapiens
aatacaccccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggccggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgacctcatgggtgtggactatgaggagatgtgtcactggctctgccatcggaaactggctactgccacagagacatacatcaagcccatctccaagctgcaggccacgaatgcccgcgatgctttggccaaacacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactattgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaaaatgacaaatcttattaaaatatgtgcaatatttatggaagtcaaacagcttcatatcagtgataaagattgttattaaaagataaatactgtctgttaatttaca

SEQ ID NO: 323282 - DNA, 7599 bp, Homo sapiens
aatacaccccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggccggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgacctcatgggtgtggactatgaggagatgtgtcactggctctgccatcggaaactggctactgccacagagacatacatcaagcccatctccaagctgcaggccacgaatgcccgcgatgctttggccaaacacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactattgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaaaatgacaaatcttattaaaatatgtgcaatatttatggaagtcaaacagcttcatatcagtgataaagattgttattaaaagataaatactgtctgttaatttaca

SEQ ID NO: 323283 - DNA, 7680 bp, Homo sapiens
aatacaccccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggccggggggcgtaggcgcgcggggcccgccatggctgcgtcggagctctacacaaagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgacctcatgggtgtggactatgaggagatgtgtcactggctctgccatcggaaactggctactgccacagagacatacatcaagcccatctccaagctgcaggccacgaatgcccgcgatgctttggccaaacacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactattgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagaggattgtcagaatattcacgattcaggtcttgaaactttgattatgcaaaagaaggtatataataaatatttcattatgattcagtttttaaggctttgcagcttctataagtgttctcagatgccactagataattttaaaagcatcatattagaaatactttaagaagacttatataagaaatagaagattgttgaattttacagaggatttggttcattaagacccagattctgtaagttttcattctgaaattctagttaaacatattcaccatttttcttaggaatcttatacaataaatccttcaggttgcacaaaagcaaattattagttttcattagaaactctggttctgaattacaatcataggttatataaatttaactgttagatggtctataaaaatgacaaatcttattaaaatatgtgcaatatttatggaagtcaaacagcttcatatcagtgataaagattgttattaaaagataaatactgtctgttaatttaca
